United States Patent
Ye et al.

(10) Patent No.: US 10,188,650 B2
(45) Date of Patent: Jan. 29, 2019

(54) TREATMENT OF NEUROLOGICAL DISORDERS

(71) Applicant: THE REGENTS OF THE UNIVERSITY OF MICHIGAN, Ann Arbor, MI (US)

(72) Inventors: Bing Ye, Ann Arbor, MI (US); Jung Hwan Kim, Ann Arbor, MI (US); Gabriella Sterne, Ann Arbor, MI (US)

(73) Assignee: THE REGENTS OF THE UNIVERSITY OF MICHIGAN, Ann Arbor, MI (US)

( * ) Notice: Subject to any disclaimer, the term of this patent is extended or adjusted under 35 U.S.C. 154(b) by 0 days.

(21) Appl. No.: 15/108,953

(22) PCT Filed: Dec. 23, 2014

(86) PCT No.: PCT/US2014/072083
§ 371 (c)(1),
(2) Date: Jun. 29, 2016

(87) PCT Pub. No.: WO2015/103026
PCT Pub. Date: Jul. 9, 2015

(65) Prior Publication Data
US 2016/0346281 A1    Dec. 1, 2016

Related U.S. Application Data

(60) Provisional application No. 61/923,492, filed on Jan. 3, 2014.

(51) Int. Cl.
| | | |
|---|---|---|
| *A61K 31/506* | (2006.01) | |
| *A01K 67/033* | (2006.01) | |
| *A61K 31/496* | (2006.01) | |
| *A61K 31/5025* | (2006.01) | |
| *C07K 16/40* | (2006.01) | |
| *C12N 15/113* | (2010.01) | |
| *C12Q 1/6883* | (2018.01) | |

(52) U.S. Cl.
CPC ........ *A61K 31/506* (2013.01); *A01K 67/0339* (2013.01); *A61K 31/496* (2013.01); *A61K 31/5025* (2013.01); *C07K 16/40* (2013.01); *C12N 15/1137* (2013.01); *C12Q 1/6883* (2013.01); *A01K 2217/15* (2013.01); *A01K 2227/105* (2013.01); *A01K 2227/706* (2013.01); *A01K 2267/0356* (2013.01); *C07K 2317/76* (2013.01); *C12N 2320/30* (2013.01); *C12Q 2600/158* (2013.01)

(58) Field of Classification Search
CPC ............... A61K 31/506; A61K 31/496; A61K 31/5025; A61K 39/395; C07K 16/40; C07K 2317/76; C12N 15/1137; C12N 2320/30; A01K 67/0339; A01K 2267/3056; A01K 2227/706; C12Q 2600/158; C12Q 1/6883
See application file for complete search history.

(56) References Cited

U.S. PATENT DOCUMENTS

| | | |
|---|---|---|
| 4,735,210 A | 4/1988 | Goldenberg |
| 4,816,567 A | 3/1989 | Cabilly et al. |
| 5,225,539 A | 7/1993 | Winter |
| 5,641,870 A | 6/1997 | Rinderknecht et al. |
| 5,731,168 A | 3/1998 | Carter |
| 8,697,359 B1 | 4/2014 | Zhang |
| 2005/0090732 A1 | 4/2005 | Ivkov |
| 2013/0072481 A1 | 3/2013 | Mensa-Wilmot |
| 2016/0346281 A1 | 12/2016 | Ye et al. |

FOREIGN PATENT DOCUMENTS

| | | |
|---|---|---|
| EP | 0125023 A1 | 11/1984 |
| EP | 0171496 A2 | 2/1986 |
| EP | 0173494 A2 | 3/1986 |
| EP | 0184187 A2 | 6/1986 |
| WO | WO/1986/001533 | 3/1986 |
| WO | WO/1987/002671 | 5/1987 |
| WO | WO/2012/118599 | 9/2012 |
| WO | WO/2013/166295 | 11/2013 |
| WO | WO/2015/103026 | 7/2015 |

OTHER PUBLICATIONS

GenBank Accession No. NC_006088.3, retrieved Dec. 28, 2016, 4 pages.
GenBank Accession No. NC_006104.3, retrieved Dec. 28, 2016, 3 pages.
GenBank Accession No. NC_006476.3, retrieved Dec. 28, 2016, 3 pages.
GenBank Accession No. NC_006488.2, retrieved Dec. 28, 2016, 2 pages.
GenBank Accession No. NC_006591.3, retrieved Dec. 28, 2016, 2 pages.
GenBank Accession No. NC_006613.3, retrieved Dec. 28, 2016, 273 pages.
GenBank Accession No. NC_007116.5, retrieved Dec. 28, 2016, 3 pages.
GenBank Accession No. NC_007121.5, retrieved Dec. 28, 2016, 2 pages.
GenBank Accession No. NC_007860.1, retrieved Dec. 28, 2016, 3 pages.

(Continued)

*Primary Examiner* — Sudhakar Katakam
(74) *Attorney, Agent, or Firm* — Casimir Jones S.C.; David Casimir; Thomas Isenbarger

(57) ABSTRACT

Provided herein is technology relating to treatment of neurological disorders and particularly, but not exclusively, to methods and compositions for treating neurological disorders caused by aberrant and/or dysregulated expression and/or activity of Down syndrome cell adhesion molecule (Dscam) with agents that modulate physiological components associated with the functions and/or dysfunctions of Dscam, e.g., physiological components that can be modulated to counteract aberrant Dscam expression and/or activity such as Abelson murine leukemia viral oncogene homolog 1 kinase.

10 Claims, 10 Drawing Sheets

Specification includes a Sequence Listing.

(56) References Cited

OTHER PUBLICATIONS

GenBank Accession No. NC_007872.1, retrieved Dec. 28, 2016, 2 pages.
GenBank Accession No. NG_012034.1, retrieved Dec. 28, 2016, 44 pages.
GenBank Accession No. NM_001030224.1, retrieved Dec. 28, 2016, 4 pages.
GenBank Accession No. NM_001043131.2, retrieved Dec. 28, 2016, 5 pages.
GenBank Accession No. NM_001100850.1, retrieved Dec. 28, 2016, 4 pages.
GenBank Accession No. NM_001112703.2, retrieved Dec. 28, 2016, 5 pages.
GenBank Accession No. NM_001206860.1, retrieved Dec. 28, 2016, 3 pages.
GenBank Accession No. NM_001389.3, retrieved Dec. 28, 2016, 8 pages.
GenBank Accession No. NM_005157.4, retrieved Dec. 28, 2016, 12 pages.
GenBank Accession No. NM_007313.2, retrieved Dec. 28, 2016, 6 pages.
GenBank Accession No. NM_031174.4, retrieved Dec. 28, 2016, 8 pages.
GenBank Accession No. NM_080104.3, retrieved Dec. 28, 2016, 5 pages.
GenBank Accession No. NM_133587.1, retrieved Dec. 28, 2016, 4 pages.
GenBank Accession No. NP_001025395.1, retrieved Dec. 28, 2016, 5 pages.
GenBank Accession No. NP_001036596.2, retrieved Dec. 28, 2016, 6 pages.
GenBank Accession No. NP_001094320.1, retrieved Dec. 28, 2016, 4 pages.
GenBank Accession No. NP_001106174.1, retrieved Dec. 28, 2016, 4 pages.
GenBank Accession No. NP_001193789.1, retrieved Dec. 28, 2016, 3 pages.
GenBank Accession No. NP_001380.2, retrieved Dec. 28, 2016, 6 pages.
GenBank Accession No. NP_005148.2, retrieved Dec. 28, 2016, 9 pages.
GenBank Accession No. NP_009297.2, retrieved Dec. 28, 2016, 4 pages.
GenBank Accession No. NP_112451.1, retrieved Dec. 28, 2016, 4 pages.
GenBank Accession No. NP_524843.2, retrieved Dec. 28, 2016, 5 pages.
GenBank Accession No. NP_598271.1, retrieved Dec. 28, 2016, 5 pages.
GenBank Accession No. XM_001118598.2, retrieved Dec. 28, 2016, 3 pages.
GenBank Accession No. XM_001166213.3, retrieved Dec. 28, 2016, 4 pages.
GenBank Accession No. XM_001171538.1, retrieved Dec. 28, 2016, 4 pages.
GenBank Accession No. XM_001233811.3, retrieved Dec. 28, 2016, 3 pages.
GenBank Accession No. XM_001337793.5, retrieved Dec. 28, 2016, 3 pages.
GenBank Accession No. XM_002685111.2, retrieved Dec. 28, 2016, 3 pages.
GenBank Accession No. XM_002803124.1, retrieved Dec. 28, 2016, 3 pages.
GenBank Accession No. XM_308666.4, retrieved Dec. 28, 2016, 3 pages.
GenBank Accession No. XM_315093.4, retrieved Dec. 28, 2016, 3 pages.
GenBank Accession No. XM_416734.3, retrieved Dec. 28, 2016, 3 pages.
GenBank Accession No. XM_544893.3, retrieved Dec. 28, 2016, 3 pages.
GenBank Accession No. XM_548413.4, retrieved Dec. 28, 2016, 3 pages.
GenBank Accession No. XP_001118598.2, retrieved Dec. 28, 2016, 1 page.
GenBank Accession No. XP_001166213.2, retrieved Dec. 28, 2016, 2 pages.
GenBank Accession No. XP_001171538.1, retrieved Dec. 28, 2016, 2 pages.
GenBank Accession No. XP_001233812.1, retrieved Dec. 28, 2016, 2 pages.
GenBank Accession No. XP_001337829.1, retrieved Dec. 28, 2016, 2 pages.
GenBank Accession No. XP_002685157.1, retrieved Dec. 28, 2016, 2 pages.
GenBank Accession No. XP_002803170.1, retrieved Dec. 28, 2016, 2 pages.
GenBank Accession No. XP_308666.4, retrieved Dec. 28, 2016, 5 pages.
GenBank Accession No. XP_315093.4, retrieved Dec. 28, 2016, 3 pages.
GenBank Accession No. XP_416734.3, retrieved Dec. 28, 2016, 2 pages.
GenBank Accession No. XP_544893.3, retrieved Dec. 28, 2016, 2 pages.
GenBank Accession No. XP_548413.3, retrieved Dec. 28, 2016, 3 pages.
International Search Report of parent PCT/US2014/072083, dated Jul. 2, 2015, 18 pages.
Amano et al., "Association study between the Down syndrome cell adhesion molecule (DSCAM) gene and bipolar disorder." Psychiatr Genet. Feb. 2008;18(1):1-10.
Andolina et al., "How I treat childhood CML" Blood. Feb. 23, 2012;119(8):1821-30.
Andrews et al., "Dscam guides embryonic axons by Netrin-dependent and -independent functions." Development. Dec. 2008;135(23):3839-48.
Aplenc et al., "Pediatric phase I trial and pharmacokinetic study of dasatinib: a report from the children's oncology group phase I consortium." J Clin Oncol. Mar. 1, 2011;29(7):839-44.
Beidler et al., "Cloning and high level expression of a chimeric antibody with specificity for human carcinoembryonic antigen." J Immunol. Dec. 1, 1988;141(11):4053-60.
Bennett et al., "Increased levels of the *Drosophila* Abelson tyrosine kinase in nerves and muscles: subcellular localization and mutant phenotypes imply a role in cell-cell interactions." Development. Dec. 1992;116(4):953-66.
Bernstein et al., "Role for a bidentate ribonuclease in the initiation step of RNA interference." Nature. Jan. 18, 2001;409(6818):363-6.
Better et al., "*Escherichia coli* secretion of an active chimeric antibody fragment." Science. May 20, 1988;240(4855):1041-3.
Bischof et al., "An optimized transgenesis system for *Drosophila* using germ-line-specific phiC31 integrases." Proc Natl Acad Sci U S A. Feb. 27, 2007;104(9):3312-7.
Bradley et al., "Regulation of cell migration and morphogenesis by Abl-family kinases: emerging mechanisms and physiological contexts." J Cell Sci. Oct. 1, 2009;122(Pt 19):3441-54.
Brasher et al., "c-Abl has high intrinsic tyrosine kinase activity that is stimulated by mutation of the Src homology 3 domain and by autophosphorylation at two distinct regulatory tyrosines." J Biol Chem. Nov. 10, 2000;275(45):35631-7.
Brennan et al., "Preparation of bispecific antibodies by chemical recombination of monoclonal immunoglobulin G1 fragments." Science. Jul. 5, 1985;229(4708):81-3.
Bueno et al., "Genetic and epigenetic silencing of microRNA-203 enhances ABL1 and BCR-ABL1 oncogene expression." Cancer Cell. Jun. 2008;13(6):496-506.
Cancino et al., "STI571 prevents apoptosis, tau phosphorylation and behavioural impairments induced by Alzheimer's beta-amyloid deposits." Brain. Sep. 2008;131(Pt 9):2425-42.

(56) References Cited

OTHER PUBLICATIONS

Champagne et al., "Higher dose imatinib for children with de novo chronic phase chronic myelogenous leukemia: a report from the Children's Oncology Group. Pediatr Blood Cancer. Jul. 15, 2011;57(1):56-62.
Clackson et al., "Making antibody fragments using phage display libraries." Nature. Aug. 15, 1991;352(6336):624-8.
Cole et al., "The EBV-hybridoma technique and its application to human lung cancer." Monoclonal Antibodies and Cancer Therapy 27 (1985): 77-96.
Comprehensive Heterocyclic Chemistry II, A. R. Katritzky and C. W. Rees (Eds) Pergamon, Oxford 1996, vol. 1-11, Table of Contents provided, sections available upon Examiner request.
Comprehensive Heterocyclic Chemistry, A. R. Katritzky and C. W. Rees (Eds) Pergamon, Oxford 1984, vol. 1-9. Table of Contents provided, sections available upon Examiner request.
Comprehensive Organic Synthesis, B. Trost and I. Fleming (Eds.) vol. 1-9 Pergamon, Oxford, 1991. Table of Contents provided, sections available upon Examiner request.
Cvetkovska et al., "Overexpression of Down syndrome cell adhesion molecule impairs precise synaptic targeting." Mat Neurosci. Jun. 2013;16(6):677-82.
Darnell et al., "FMRP stalls ribosomal translocation on mRNAs linked to synaptic function and autism." Cell. Jul. 22, 2011;146(2):247-61.
Dockendorff et al., "*Drosophila* lacking dfmr1 activity show defects in circadian output and fail to maintain courtship interest." Neuron. Jun. 13, 2002;34(6):973-84.
Elbashir et al., "RNA interference is mediated by 21- and 22-nucleotide RNAs." Genes Dev. Jan. 15, 2001;15(2):188-200.
Elbashir et al., "Duplexes of 21-nucleotide RNAs mediate RNA interference in cultured mammalian cells" Nature. May 24, 2001;411(6836):494-8.
Fieser and Fieser's Reagents for Organic Synthesis, Wiley & Sons: New York, vols. 1-21 ; R. C. LaRock, Comprehensive Organic Transformations, 2nd edition Wiley-VCH, New York 1999. Table of Contents provided, sections available upon Examiner request.
Gertler et al., "*Drosophila* abl tyrosine kinase in embryonic CNS axons: a role in axonogenesis is revealed through dosage-sensitive interactions with disabled." Cell. Jul. 14, 1989;58(1):103-13.
Goding, Monoclonal Antibodies: Principles and Practice, Academic Press, 1986. Table of Contents provided, sections available upon Examiner request.
Grossman et al., "Over-expression of DSCAM and COL6A2 cooperatively generates congenital heart defects." PLoS Genet. Nov. 2011;7(11);e1002344. 12 pages.
Gruber et al., "Efficient tumor cell lysis mediated by a bispecitic single chain antibody expressed in *Escherichia coli*." J Immunol. Jun. 1, 1994;152(11):5368-74.
Sawhney et al., "Bioerodible hydrogels based on photopolymerized poly(ethylene glycol)-co-poly(.alpha.-hydroxy acid) diacrylate macromers" Macromolecules, 1993, 26 (4), pp. 581-587.
Hsu et al., "Development and applications of CRISPR-Cas9 for genome engineering." Cell. Jun. 5, 2014;157(6):1262-78.
Huse et al., "Generation of a large combinatorial library of the immunoglobulin repertoire in phage lambda." Science. Dec. 8, 1989;246(4935):1275-81.
Hutvagner et al., "A microRNA in a multiple-turnover RNAi enzyme complex." Science. Sep. 20, 2002;297(5589):2056-60.
Hwang et al., "Nociceptive neurons protect *Drosophila* larvae from parasitoid wasps." Curr Biol. Dec. 18, 2007;17(24):2105-16.
Lossifov et al., "The contribution of de novo coding mutations to autism spectrum disorder." Nature. Nov. 13, 2014;515(7526):216-21.
Jones et. al., "Replacing the complementarity-determining regions in a human antibody with those from a mouse." Nature. May 29-Jun. 4, 1986;321(6069):522-5.
Ketting et al., "Dicer functions in RNA interference and in synthesis of small RNA involved in developmental timing in C. elegans." Genes Dev. Oct. 15, 2001;15(20):2654-9.
Martinez et al., "Single-stranded antisense siRNAs guide target RNA cleavage in RNAi." Cell. Sep. 6, 2002;110(5):563-74.
Kim et al., "Dscam expression levels determine presynaptic arbor sizes in *Drosophila* sensory neurons." Neuron. Jun. 5, 2013;78(5):827-38.
Kisielow et al., "Isoform-specific knockdown and expression of adaptor protein ShcA using small interfering RNA." Biochem J. Apr. 1, 2002;363(Pt 1):1-5.
Köhler et al., "Continuous cultures of fused cells secreting antibody of predefined specificity." Nature. Aug. 7, 1975;256(5517):495-7.
Kostelny et al., "Formation of a bispecific antibody by the use of leucine zippers." J Immunol. Mar. 1, 1992;148(5):1547-53.
Kozbor et al., "The production of monoclonal antibodies from human lymphocytes." Immunol Today. Mar. 1983;4(3):72-9.
Kremer et al., "Mapping of DNA instability at the fragile X to a trinucleotide repeat sequence p(CCG)n." Science. Jun. 21, 1991;252(5013):1711-4.
Kuo et al., "Dendrite-specific remodeling of *Drosophila* sensory neurons requires matrix metalloproteases, ubiquitin-proteasome, and ecdysone signaling." Proc Natl Acad Sci U S A. Oct. 18, 2005;102(42):15230-5.
Coloma et al., "Primer design for the cloning of immunoglobulin heavy-chain leader-variable regions from mouse hybridoma cells using the PCR." Biotechniques. Aug. 1991;11(2):152-4, 156.
Larrick et al., "(1991) PCR Amplification of Antibody Genes" Methods: Companion to Methods in Enzymology, 2:106-110.
Larsen et al., "Development of layer-specific axonal arborizations in mouse primary somatosensory cortex." J Comp Neurol. Jan. 20, 2006;494(3):398-414.
Lee et al., "Mosaic analysis with a repressible cell marker for studies of gene function in neuronal morphogenesis." Neuron. Mar. 1999;22(3):451-61.
Lee et al., "Mosaic analysis with a repressible cell marker (MARCM) for *Drosophila* neural development." Trends Neurosci. May 2001;24(5):251-4.
Liu et al., "Production of a mouse-human chimeric monoclonal antibody to CD20 with potent Fc-dependent biologic activity." J Immunol. Nov. 15, 1987;139(10):3521-6.
Liu et al., "Chimeric mouse-human IgG1 antibody that can mediate lysis of cancer cells." Proc Natl Acad Sci U S A. May 1987;84(10):3439-43.
Marks et al., "By-passing immunization. Human antibodies from V-gene libraries displayed on phage." J Mol Biol. Dec. 5, 1991;222(3):581-97.
Maynard et al., "DSCAM contributes to dendrite arborization and spine formation in the developing cerebral cortex." J Neurosci. Nov. 21, 2012;32(47):16637-50.
McCafferty et al., "Phage antibodies: filamentous phage displaying antibody variable domains." Nature. Dec. 6, 1990;348(6301):552-4.
Millot et al., "Imatinib is effective in children with previously untreated chronic myelogenous leukemia in early chronic phase: results of the French national phase IV trial." J Clin Oncol. Jul. 10, 2011;29(20):2827-32.
Milstein et al., "Hybrid hybridomas and their use in immunohistochemistry." Nature. Oct. 6-12, 1983;305(5934):537-40.
Morimoto et al., "Single-step purification of F(ab')2 fragments of mouse monoclonal antibodies (immunoglobulins G1) by hydrophobic interaction high performance liquid chromatography using TSKgel Phenyl-5PW." J Biochem Biophys Methods. Mar. 1992;24(1-2):107-17.
Cheung et al., "Integration of cytogenetic landmarks into the draft sequence of the human genome." Nature. Feb. 15, 2001;409(6822):953-8.
Nishimura et al., "Recombinant human-mouse chimeric monoclonal antibody specific for common acute lymphocytic leukemia antigen." Cancer Res. Feb. 15, 1987;47(4):999-1005.
Nykanen et al., "ATP requirements and small interfering RNA structure in the RNA interference pathway." Cell. Nov. 2, 2001;107(3):309-21.
Oi et al., "Chimeric antibodies." BioTechniques 4, No. 3 (1986): 214-221.

(56) References Cited

OTHER PUBLICATIONS

Organic Reactions, Wiley & Sons: New York, 1991, vols. 1-40. Table of Contents provided, sections available upon Examiner request.
Orlandi et al., "Cloning immunoglobulin variable domains for expression by the polymerase chain reaction." Proc Natl Acad Sci U S A. May 1989;86(10):3833-7.
Pluckthun et al., "Antibodies from *Escherichia coli*" The pharmacology of monoclonal antibodies, M. Rosenberg and G. P. Moore, Eds. (Springer Verlag, Berlin, 1994), vol. 113, pp. 269-315.
Provost et al., "Ribonuclease activity and RNA binding of recombinant human Dicer." EMBO J. Nov. 1, 2002;21(21):5864-74.
Remington's Pharmaceutical Sciences, 17th Edition, p. 1418 (1985).
Remington's Pharmaceutical Sciences, 18th edition, edited by A. R. Gennaro, Mack Publishing Co., 1990. Table of Contents provided, sections available upon Examiner request.
Remingtons Pharmaceutical Sciences, Mack Publishing Co. (A. R. Gennaro edit. 1985. Table of Contents provided, sections available upon Examiner request.
Morrison et al., "Transfectomas provide novel chimeric antibodies." Science. Sep. 20, 1985;229(4719):1202-7.
Saito et al., "The developmental and aging changes of Down's syndrome cell adhesion molecule expression in normal and Down's syndrome brains." Acta Neuropathol. Dec. 2000;100(6):654-64.
Sastry et al., "Cloning of the immunological repertoire in *Escherichia coli* for generation of monoclonal catalytic antibodies: construction of a heavy chain variable region-specific cDNA library." Proc Natl Acad Sci U S A. Aug. 1989;86(15):5728-32.
Shalaby et al., "Development of humanized bispecitic antibodies reactive with cytotoxic lymphocytes and tumor cells overexpressing the HER2 protooncogene." J Exp Med. Jan. 1, 1992;175(1):217-25.
Sharp et al., "RNA interference—2001." Genes Dev. Mar. 1, 2001;15(5):485-90.
Shaw et al., "Mouse/human chimeric antibodies to a tumor-associated antigen: biologic activity of the four human IgG subclasses." J Natl Cancer Inst. Dec. 7, 1988;80(19):1553-9.
Shen et al., "Altered expression of Dscam in temporal lobe tissue from human and experimental animals." Synapse. Oct. 2011;65(10):975-82.
Stevens et al., "Using Bcr-Abl to examine mechanisms by which abl kinase regulates morphogenesis in *Drosophila*." Mol Biol Cell. Jan. 2008;19(1):378-93.
Sun et al., "Chimeric antibody with human constant regions and mouse variable regions directed against carcinoma-associated antigen 17-1A." Proc Natl Acad Sci U S A. Jan. 1987;84(1):214-8.
Suresh et al., "Bispecitic monoclonal antibodies from hybrid hybridomas." Methods Enzymol. 1986;121:210-28.
Tabara et al., "The dsRNA binding protein RDE-4 interacts with RDE-1, DCR-1, and a DExH-box helicase to direct RNAi in C. elegans." Cell. Jun. 28, 2002;109(7):861-71.
Tanis et al., "Two distinct phosphorylation pathways have additive effects on Abl family kinase activation." Mol Cell Biol. Jun. 2003;23(11):3884-96.
Traunecker et al., "Bispecific single chain molecules (Janusins) target cytotoxic lymphocytes on HIV infected cells." EMBO J. Dec. 1991;10(12):3655-9.
Tuschl et al., "Targeted mRNA degradation by double-stranded RNA in vitro." Genes Dev. Dec. 15, 1999;13(24):3191-7.
Verhoeyen et al., "Reshaping human antibodies: grafting an antilysozyme activity." Science. Mar. 25, 1988;239(4847):1534-6.
Wills et al., "The tyrosine kinase Abl and its substrate enabled collaborate with the receptor phosphatase Dlar to control motor axon guidance." Neuron. Feb. 1999;22(2):301-12.
Wood et al., "The synthesis and in vivo assembly of functional antibodies in yeast." Nature. Apr. 4-10, 1985;314(6010):446-9.
Ye et al., "Differential regulation of dendritic and axonal development by the novel Krüppel-like factor Dar1." J Neurosci. Mar. 2, 2011;31(9):3309-19.
Yu et al., "Endodomain diversity in the *Drosophila* Dscam and its roles in neuronal morphogenesis." J Neurosci. Feb. 11, 2009;29(6):1904-14.
Zhang et al., "*Drosophila* fragile X-related gene regulates the MAP1B homolog Futsch to control synaptic structure and function." Cell. Nov. 30, 2001;107(5):591-603.
GenBank Accession No. NC_000068.7, retrieved Dec. 28, 2016, 2 pages.
GenBank Accession No. AC_000158.1, retrieved Dec. 28, 2016, 2 pages.
GenBank Accession No. AC_000168.1, retrieved Dec. 28, 2016, 2 pages.
GenBank Accession No. NC_000009.11, retrieved Dec. 28, 2016, 3 pages.
GenBank Accession No. NC_000021.8, retrieved Dec. 28, 2016, 2 pages.
GenBank Accession No. NC_000082.6, retrieved Dec. 28, 2016, 2 pages.
GenBank Accession No. NC_005102.3, retrieved Dec. 28, 2016, 5 pages.
GenBank Accession No. NC_005110.3, retrieved Dec. 28, 2016, 5 pages.

A

B

TREATMENT OF NEUROLOGICAL DISORDERS

This application is a 371 U.S. National Phase Entry of pending International Application No. PCT/US2014/072083, filed Dec. 23, 2014, which claims priority to U.S. provisional patent application Ser. No. 61/923,492, filed Jan. 3, 2014, each of which is incorporated herein by reference in its entirety.

STATEMENT REGARDING FEDERALLY SPONSORED RESEARCH OR DEVELOPMENT

This invention was made with government support under MH091186 awarded by the National Institutes of Health. The Government has certain rights in the invention.

FIELD

Provided herein is technology relating to treatment of neurological disorders and particularly, but not exclusively, to methods and compositions for treating neurological disorders caused by aberrant and/or dysregulated expression and/or activity of Down syndrome cell adhesion molecule (Dscam) with agents that modulate physiological components associated with the functions and/or dysfunctions of Dscam, e.g., physiological components that can be modulated to counteract aberrant Dscam expression and/or Dscam activity such as Abelson murine leukemia viral oncogene homolog 1 kinase.

BACKGROUND

Down syndrome is the most common chromosome abnormality in humans, affecting more than 1 in 1000 births in the United States. Despite this prevalence, no known effective treatments exist for subjects afflicted with Down syndrome and related neurological diseases such as epilepsy, bipolar disorders, and fragile X mental retardation. The deficiency exists largely because the etiological mechanisms of these diseases are poorly understood. Accordingly, the development of therapeutic approaches and therapeutic agents useful in remedying the pathogenesis of these neurological and mental disorders would be advanced by the identification of drug targets associated with these neurological disorders and by the identification of effective drugs to ameliorate these diseases.

SUMMARY

As such, research has been targeted at understanding the biological aberrations that lead to such neurological anomalies. Some research has indicated that aberrant and/or dysregulated expression and/or activity of Dscam (Down syndrome cell-adhesion molecule) is implicated in several of these neurological and mental disorders. For example, studies in mouse models and in humans reported increased Dscam expression in Down syndrome (see, e.g., Saito et al. (2000) "The developmental and aging changes of Down's syndrome cell adhesion molecule expression in normal and Down's syndrome brains" *Acta Neuropathologica* 100: 654-664), intractable epilepsy (see, e.g., Shen et al. (2011) "Altered expression of Dscam in temporal lobe tissue from human and experimental animals" *Synapse* 65: 975-982), and in bipolar disorder (see, e.g., Amano et al. (2008) "Association study between the Down syndrome cell adhesion molecule (DSCAM) gene and bipolar disorder" *Psychiatric Genetics* 18: 1-10).

In addition, research indicates that Dscam protein is increased in the nervous system of a *Drosophila melanogaster* model of fragile X syndrome (see, e.g., Cvetkovska (2013) "Overexpression of Down syndrome cell adhesion molecule impairs precise synaptic targeting" *Nature Neuroscience* 16: 677; Kim et al. (2013) "Dscam expression levels determine axon terminal sizes in *Drosophila* sensory neurons" *Neuron* 78(5): 827-838). Moreover, additional insight into the mechanisms producing certain neurological anomalies was provided by the finding that increased Dscam expression leads to the overgrowth of axon terminals (see, e.g., Kim et al. (2013) "Dscam expression levels determine axon terminal sizes in *Drosophila* sensory neurons" *Neuron* 78: 827). In sum, while studies on both patient brains and animal models suggested that aberrant and/or dysregulated Dscam expression and/or activity is a common factor contributing to multiple neurological and mental disorders, the biological pathways connecting Dscam with the phenotypes of neurological disease were not known.

Accordingly, provided herein is technology related to agents targeting biological components that mediate the connection between Dscam and neurological disease. In particular, genetic and pharmacological data collected during the development of embodiments of the technology provided herein indicated that the Abelson murine leukemia viral oncogene homolog 1 (Abl) kinase is a mediator of phenotypes associated with aberrant axonal growth caused by increased expression and/or activity of Dscam. While Abl was known to promote axonal growth and have a functional relationship to Dscam, the nature of this functional relationship was unknown. Specifically, it was not known if neuronal defects caused by increased Dscam levels could be ameliorated by inhibiting Abl expression or activity.

Experiments were performed and data were collected indicating that axon overgrowth caused by increased Dscam expression and/or activity was eliminated and/or minimized in a *Drosophila melanogaster* model by the loss of Abl kinase gene functions. Furthermore, inhibiting Abl kinase activity nearly eliminated and/or minimized the axon overgrowth caused by increased Dscam expression and/or activity.

Accordingly, provided herein are methods, compositions, and related technologies related to the therapeutic use of Abl kinase inhibitors for neurological and mental disorders associated with aberrant and/or dysregulated Dscam expression or activity, including but not limited to Down syndrome, epilepsy, bipolar disorder, and fragile X mental retardation. In particular, experiments were conducted with nilotinib, which is a second-generation Abl kinase inhibitor that is capable of crossing the blood-brain barrier and has found use as a potent cancer drug. Currently, nilotinib is being investigated at low doses for use in treating some neurodegenerative diseases, specifically Parkinson's and Alzheimer's diseases. However, the use of nilotinib and other Abl kinase inhibitors in neurological and mental disorders that involve Dscam, including but not limited to Down syndrome, epilepsy, bipolar disorder, and fragile X mental retardation, has not been proposed.

For example, some embodiments provide a composition for treating a subject having a neurological disorder, the composition comprising an inhibitor of a tyrosine kinase. In some embodiments, the neurological disorder is associated with an aberrant and/or a dysregulated expression of Dscam and, in some embodiments, the tyrosine kinase is associated with the functions and/or dysfunctions of Dscam. For example, in some embodiments the tyrosine kinase can be modulated to counteract aberrant Dscam expression and/or activity. Without being limited to particular embodiments, the technology contemplates, e.g., a tyrosine kinase that forms a complex with Dscam, a tyrosine kinase that acts in a biological pathway with Dscam (e.g., a tyrosine kinase that acts in a biological pathway upstream of Dscam and/or a tyrosine kinase that acts in a biological pathway downstream of Dscam), and/or a tyrosine kinase that is otherwise involved at least partially in producing, mediating, transmitting, etc. a neurological phenotype associated with aberrant Dscam expression and/or activity, such as Abelson murine leukemia viral oncogene homolog 1 kinase.

In some embodiments, the neurological disorder is Down syndrome, epilepsy, bipolar disorder, or fragile X mental retardation. The technology is not limited in the tyrosine kinase, e.g., in some embodiments, the tyrosine kinase is Abl. Moreover, the technology is not limited in the inhibitor. For example, some embodiments provide that the inhibitor is imatinib, nilotinib, dasatinib, bosutinib, bafetinib, or ponatinib. Some embodiments provide for compositions comprising more than one inhibitor.

All types of inhibitors are contemplated by the technology—e.g., in some embodiments the inhibitor is an antibody, e.g., an antibody specific for a tyrosine kinase, e.g., an antibody specific for Abl or an epitope of Abl. In some embodiments, the inhibitor is a small RNA inhibitor (e.g., a miRNA, a siRNA, and the like) of Abl expression. In some embodiments, Abl expression and/or activity is modulated by a therapy comprising use of a CRISPR/Cas9 genome editing technology, e.g., comprising use of a Cas9 protein and one or more guide RNAs targeting Abl (see, e.g., U.S. Pat. No. 8,697,359 and Hsu et al (2014) "Development and Applications of CRISPR-Cas9 for Genome Engineering" Cell 157: 1262, each incorporated herein by reference in its entirety for all purposes).

The composition is suitable for administration to a subject having a neurological disorder or, in some embodiments, the composition is suitable for administration to a subject having a neurological disorder and not having a cancer. In some embodiments, the neurological disorder comprises increased length of axon terminals. In some embodiments, the composition is suitable for administration to a subject having a neurological disorder that is not Alzheimer's disease and, in some embodiments, the composition is suitable for administration to a subject having a neurological disorder that is not Parkinson's disease.

In some embodiments, the composition is suitable for administration to a subject who has a neurodevelopmental disease as a child. For example, in some embodiments, the composition is suitable for administration to a subject having a neurological disorder (e.g., Down syndrome, epilepsy, bipolar disorder, or fragile X mental retardation) and who is a child (e.g., who is 1, 2, 3, 4, 5, 6, 7, 8, 9, 10, 11, 12, 13, 14, 15, 16, 17, or 18 years old or who is a pre-natal child, e.g., a fetus or in a pre-natal stage of development). In some embodiments, the composition is suitable for administration to a child having a neurodevelopmental disease as a child (e.g., Down syndrome, epilepsy, bipolar disorder, or fragile X mental retardation) and who develops a neurodegenerative disease as an adult (e.g., Alzheimer's disease, Parkinson's disease, etc.). In some embodiments, the composition is suitable for administration to an adult subject having a neurodevelopmental disease (e.g., Down syndrome, epilepsy, bipolar disorder, or fragile X mental retardation) and who develops and/or also has a neurodegenerative disease, e.g., as an adult (e.g., Alzheimer's disease, Parkinson's disease, etc.). In some embodiments, the composition is suitable for administration to a subject having a neurodevelopmental disease (e.g., Down syndrome, epilepsy, bipolar disorder, or fragile X mental retardation) and who also has early-onset Alzheimer's disease.

Also provided are embodiments related to a pharmaceutical composition for treating a subject having a neurological disorder comprising a composition as described herein. In some embodiments, the pharmaceutical composition comprises an inhibitor that is imatinib, nilotinib, dasatinib, bosutinib, bafetinib, or ponatinib. The pharmaceutical compositions are not limited in their form, size (e.g., dosage), or preparation. In some embodiments, the technology provides a pharmaceutical composition provided as a single dose of from 300 mg to 500 mg of the inhibitor, e.g., comprising from 300 mg to 500 mg of nilotinib.

Related embodiments provide an inhibitor of a tyrosine kinase for use as a medicament to treat a neurological disorder resulting from increased length of axon terminals and/or nilotinib for use as a medicament to treat a neurological disorder resulting from an aberrant and/or a dysregulated expression of Dscam.

Further, embodiments provide a method for treating a neurological disease in a subject, the method comprising administering to the subject a tyrosine kinase inhibitor, wherein administering the tyrosine kinase inhibitor to the subject reduces or prevents at least one symptom of the neurological disease in the subject. In some embodiments, the neurological disorder is associated with an aberrant and/or a dysregulated expression of a Dscam. Particular embodiments further provide steps for testing the subject for aberrant and/or a dysregulated expression of a Dscam and/or testing the subject for increased length of neuronal axons. Some embodiments comprise inhibiting the activity and/or the expression of a tyrosine kinase, e.g., a tyrosine kinase tyrosine kinase that is associated with the functions and/or dysfunctions of Dscam, e.g., an Abl kinase.

Embodiments provide that the inhibitor is imatinib, nilotinib, dasatinib, bosutinib, bafetinib, or ponatinib. In related embodiments, the administering comprises administering a dose of from 300 mg to 500 mg of the inhibitor to the subject one or more times per day.

The methods are applicable to subjects having a neurological disorder, e.g., Down syndrome, epilepsy, bipolar disorder, or fragile X mental retardation. In some embodiments, the subject does not have a cancer (e.g., does not have a leukemia such as chronic myelogenous leukemia (CML)).

Embodiments provide a method for treating a neurological disease in a subject, the method comprising detecting an aberrant and/or a dysregulated expression of a Dscam in the subject and administering nilotinib to the subject; related embodiments provide a method for treating a neurological disease in a subject, the method comprising detecting an aberrant length of neuronal axons in the subject and administering nilotinib to the subject. Testing and/or detecting steps in embodiments of the technology comprise use of an oligonucleotide probe, an amplification oligonucleotide, or an antibody. For example, some embodiments comprise testing and/or detecting steps using an oligonucleotide probe or an amplification oligonucleotide that comprises a nucleotide sequence of DSCAM, an oligonucleotide probe or an amplification oligonucleotide that comprises a nucleotide sequence complementary to the nucleotide sequence of DSCAM, or an antibody that is specific for Dscam or an epitope of Dscam. Particular embodiments relate to the uses of an oligonucleotide probe, amplification oligonucleotide, or antibody that is labeled, e.g., fluorescently labeled.

Dscam homologs are known and/or can be identified by one of skill in the art using art-recognized bioinformatic methods. For example, Table 1 provides the names and accession numbers for DSCAM genes and Dscam proteins from a number of organisms. Accordingly, the technology provides compositions, methods, and related embodiments wherein a oligonucleotide probe or amplification oligonucleotide detects a nucleic acid having a nucleotide sequence (or complement thereof) provided by at least one of the accession numbers of Table 1 and/or a sequence (or complement thereof) of SEQ ID NO: 1 and/or a transcription product of a sequence (or complement thereof) provided in Table 1 and/or SEQ ID NO: 1, or wherein an antibody detects a protein or an epitope having a sequence provided by at least one of the accession numbers of Table 1 and/or a translation product of a sequence (or complement thereof) provided in Table 1 and/or SEQ ID NO: 1.

In some embodiments are provided a method for treating a neurological disease in a subject, the method comprising reducing the activity and/or expression of a tyrosine kinase in the subject, wherein reducing the activity and/or expression of the tyrosine kinase in the subject reduces or prevents at least one symptom of the neurological disease in the subject. An exemplary tyrosine kinase is Abl.

Abl homologs are known and/or can be identified by one of skill in the art using art-recognized bioinformatic methods. For example, Table 2 provides the names and accession numbers for ABL genes and Abl proteins from a number of organisms. Accordingly, the technology provides compositions, methods, and related embodiments wherein a oligonucleotide probe or amplification oligonucleotide detects a nucleic acid having a nucleotide sequence (or complement thereof) provided by at least one of the accession numbers of Table 2 and/or a sequence (or complement thereof) of SEQ ID NO: 2 and/or a transcription product of a sequence (or complement thereof) provided in Table 2 and/or SEQ ID NO: 2, or wherein an antibody detects a protein or an epitope having a sequence provided by at least one of the accession numbers of Table 2 and/or a translation product of a sequence (or complement thereof) provided in Table 2 and/or SEQ ID NO: 2.

In some embodiments an antibody and/or oligonucleotide finds use in altering the expression and/or activity of an ABL gene and/or an Abl protein. Accordingly, the technology provides compositions, methods, and related embodiments wherein a oligonucleotide probe or amplification oligonucleotide comprises a nucleotide sequence (or complement thereof) provided by at least one of the accession numbers of Table 2 and/or a sequence (or complement thereof) of SEQ ID NO: 2 and/or a transcription product of a sequence (or complement thereof) provided in Table 2 and/or SEQ ID NO: 2. In some embodiments, the technology provides compositions, methods, and related embodiments wherein an antibody binds to a protein or an epitope having a sequence provided by at least one of the accession numbers of Table 2 and/or a translation product of a sequence (or complement thereof) provided in Table 2 and/or SEQ ID NO: 2.

Furthermore, the technology described herein relates to a system for treating a neurological disease in a subject, the system comprising a test reagent for detecting aberrant and/or a dysregulated expression of a Dscam in the subject and a composition comprising an inhibitor of Abl tyrosine kinase, e.g., nilotinib. In some embodiments, the test reagent is an oligonucleotide probe, an amplification oligonucleotide, or an antibody. In some embodiments, the neurological disorder is Down syndrome, epilepsy, bipolar disorder, or fragile X mental retardation. Furthermore, in some embodiments the neurological disorder is associated with aberrant length of neuronal axons. In some embodiments the composition is a pharmaceutical composition formulated for administration to the subject.

The technology provides a kit for treating a neurological disease in a subject, the kit comprising a test reagent for detecting aberrant and/or a dysregulated expression of a Dscam in the subject and a composition comprising an inhibitor of Abl tyrosine kinase, e.g., nilotinib. In some embodiments, the test reagent is an oligonucleotide probe, an amplification oligonucleotide, or an antibody. In some embodiments, the neurological disorder is Down syndrome, epilepsy, bipolar disorder, or fragile X mental retardation. In some embodiments, the neurological disorder is associated with aberrant length of axons. In some embodiments, the composition is a pharmaceutical composition formulated for administration to the subject. Associated embodiments provide a kit for treating a neurological disease in a subject, the kit comprising a test reagent for detecting aberrant length of nerve axons in the subject and a composition comprising an inhibitor of Abl tyrosine kinase.

Additional embodiments will be apparent to persons skilled in the relevant art based on the teachings contained herein.

BRIEF DESCRIPTION OF THE DRAWINGS

These and other features, aspects, and advantages of the present technology will become better understood with regard to the following drawings:

FIGS. 1A to 1C show images of C4da axon terminals in the larval ventral nerve cords (VNCs). A C4da-specific driver pickpocket-Gal4 (ppk-Gal4) was used to label C4da neurons specifically with membrane GFP (mCD8:GFP) and to overexpress the Abl and Dscam transgenes. FIG. 1A shows the axon terminals of all C4da neurons in a wild-type larva; FIG. 1B shows the axon terminals of C4da neurons overexpressing Abl (OE Abl); FIG. 1C shows the axon terminals of C4da neurons overexpressing Dscam (OE Dscam). Scale bar=10 µm.

FIGS. 2A to 2F show images acquired from single C4da neurons generated by the genetic mosaic analysis with a repressible cell marker (MARCM) technique. FIG. 2A shows an axon terminal of a wild-type C4da neuron (Control); FIG. 2B is an axon terminal of a C4da neuron overexpressing Dscam (OE Dscam); FIG. 2C shows an axon terminal a C4da neuron homozygous for the abl$^1$ loss-of-function mutant allele; FIG. 2D shows an axon terminal of a C4da neuron that is overexpressing Dscam and that is homozygous for abl$^1$; FIG. 2E shows an axon terminal of a C4da neuron homozygous for another loss-of-function allele abl$^4$; FIG. 2F shows an axon terminal of a C4da neuron that is overexpressing Dscam and that is homozygous for abl$^4$. FIG. 2G shows the results of quantifying axon terminal length in each of FIGS. 2A to 2F. Scale bar=10 µm. ****, $P<0.0001$, two-tailed Student t-test.

FIG. 6B shows the results of quantifying axon terminal length in the images of FIG. 6A. Scale bar=10 μm. ***, $P<0.001$, two-tailed Student t-test.

FIG. 9a shows images indicating that the Dscam cytoplasmic domain is required for instructing axon terminal growth. Overexpression of wild-type Dscam under the control of ppk-Gal4 (FIG. 9a, middle ("OE Dscam")) leads to exuberant axon terminal overgrowth when compared to control (FIG. 9a, top ("Wild-type")). However, overexpression of a Dscam transgene that lacks most of the cytoplasmic domain (FIG. 9a, bottom ("OE DscamΔCyto")) fails to increase axon terminal growth. Scale bar is 10 μm. FIG. 9b and FIG. 9c are immunoblots indicating that Dscam binds to and activates Abl kinase. FIG. 9b shows that Dscam binds Abl via its cytoplasmic domain. S2 cells were co-transfected with Myc-tagged Abl (Abl-Myc) along with either a GFP-tagged Dscam (Dscam:GFP) construct or an empty vector. Dscam:GFP was immunoprecipitated with anti-GFP antibody and bound Abl was examined with anti-Myc antibody (FIG. 9b, top blot). Immunoprecipitated Dscam:GFP and input Dscam:GFP was examined with anti-GFP (FIG. 9b, bottom blot). FIG. 9c is an immunoblot indicating that Dscam activates Abl. Abl activation was examined from S2 cell lysates transfected with the indicated constructs by using anti-phospho-Y412-Abl antibody. The intensity of phospho-Abl was quantified, normalized to total Abl-Myc, and presented as a bar graph (n=3).

FIG. 10A shows that dFMRP mutants fed vehicle showed a significant increase (130%) in axon terminal length. FIG. 10b shows that nilotinib treatment mitigates axon terminal overgrowth caused by *Drosophila* FMRP mutations (dFMRP[50M]). The MARCM technique was used to generate and visualize single axon terminals of mutant C4da neurons. *Drosophila* larvae were raised in the presence of either nilotinib or vehicle (DMSO) for 4 days before the analysis.

Figure 1:
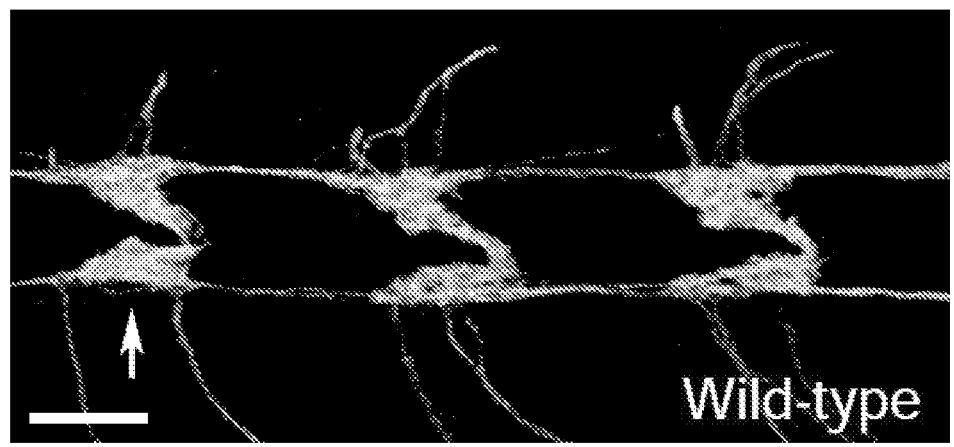
FIG. 1 is a series of images showing the overgrowth of axon terminals of the class IV dendritic arborization (C4da) neurons in *Drosophila* larva induced by overexpressing *Drosophila* Abl or Dscam.
Figure 1:
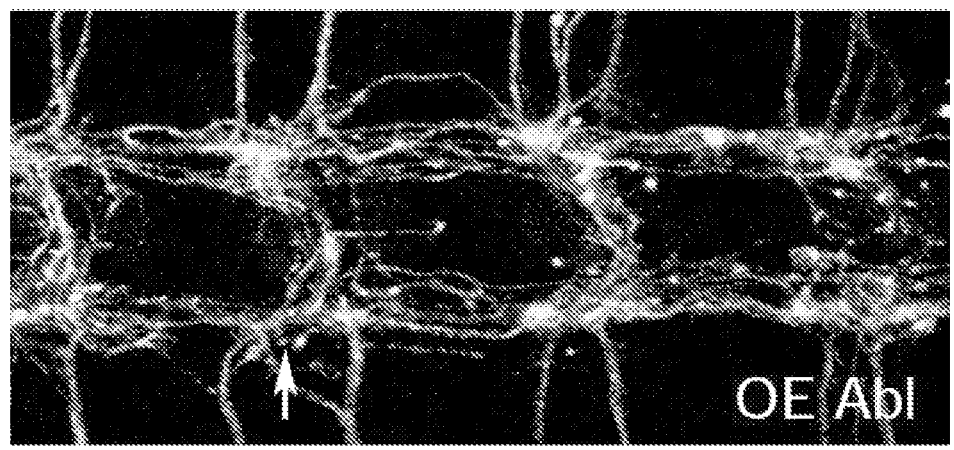
Figure 1:
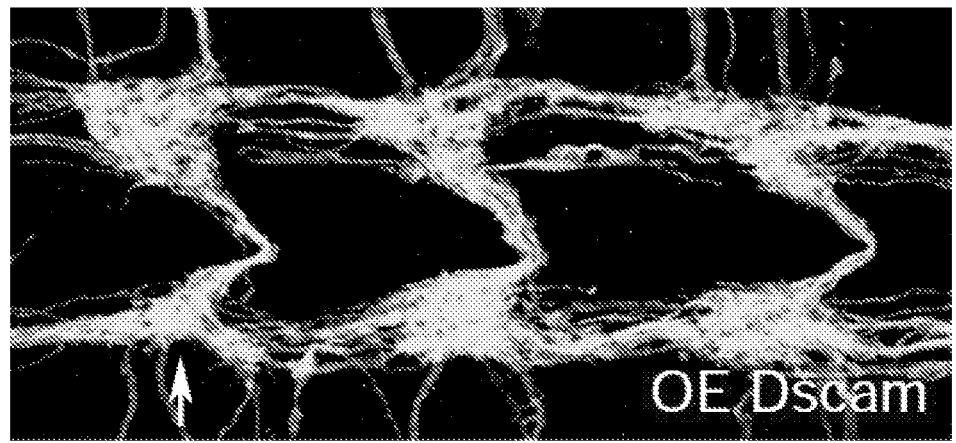

It is to be understood that the figures are not necessarily drawn to scale, nor are the objects in the figures necessarily drawn to scale in relationship to one another. The figures are depictions that are intended to bring clarity and understanding to various embodiments of apparatuses, systems, and methods disclosed herein. Wherever possible, the same reference numbers will be used throughout the drawings to refer to the same or like parts. Moreover, it should be appreciated that the drawings are not intended to limit the scope of the present teachings in any way.

DETAILED DESCRIPTION

The technology described herein provides therapeutic approaches and therapeutic agents useful in remedying the pathogenesis of neurological and mental disorders such as Down syndrome, epilepsy, bipolar disorder, and fragile X mental retardation. During the development of embodiments of the technology, data were collected that establish the Abelson murine leukemia viral oncogene homolog 1 (Abl) kinase as a critical mediator of aberrant axonal growth caused by increased expression of Dscam. Accordingly, the technology described provides, inter alia, the therapeutic use of Abl kinase inhibitors to treat neurological and mental disorders associated with aberrant and/or dysregulated Dscam expression or activity. The section headings used herein are for organizational purposes only and are not to be construed as limiting the described subject matter in any way.

In this detailed description of the various embodiments, for purposes of explanation, numerous specific details are set forth to provide a thorough understanding of the embodiments disclosed. One skilled in the art will appreciate, however, that these various embodiments may be practiced with or without these specific details. In other instances, structures and devices are shown in block diagram form. Furthermore, one skilled in the art can readily appreciate that the specific sequences in which methods are presented and performed are illustrative and it is contemplated that the sequences can be varied and still remain within the spirit and scope of the various embodiments disclosed herein.

All literature and similar materials cited in this application, including but not limited to, patents, patent applications, articles, books, treatises, and internet web pages are expressly incorporated by reference in their entirety for any purpose. Unless defined otherwise, all technical and scientific terms used herein have the same meaning as is commonly understood by one of ordinary skill in the art to which the various embodiments described herein belongs. When definitions of terms in incorporated references appear to differ from the definitions provided in the present teachings, the definition provided in the present teachings shall control.

Definitions

To facilitate an understanding of the present technology, a number of terms and phrases are defined below. Additional definitions are set forth throughout the detailed description.

Throughout the specification and claims, the following terms take the meanings explicitly associated herein, unless the context clearly dictates otherwise. The phrase "in one embodiment" as used herein does not necessarily refer to the same embodiment, though it may. Furthermore, the phrase "in another embodiment" as used herein does not necessarily refer to a different embodiment, although it may. Thus, as described below, various embodiments of the invention may be readily combined, without departing from the scope or spirit of the invention.

In addition, as used herein, the term "or" is an inclusive "or" operator and is equivalent to the term "and/or" unless the context clearly dictates otherwise. The term "based on" is not exclusive and allows for being based on additional factors not described, unless the context clearly dictates otherwise. In addition, throughout the specification, the meaning of "a", "an", and "the" include plural references. The meaning of "in" includes "in" and "on."

As used herein, the term "aberrant" refers to a deviation from the norm, e.g., the average healthy subject and/or a population of average healthy subjects. The term "aberrant expression", as used herein, refers to abnormal expression of a gene product (e.g., RNA, protein, polypeptide, or peptide) by a cell or subject relative to a normal, healthy cell or subject and/or a population of normal, healthy cells or subjects. Such aberrant expression may be the result of the amplification of the gene.

As used herein, the term "primer" refers to an oligonucleotide, whether occurring naturally as in a purified restriction digest or produced synthetically, that is capable of acting as a point of initiation of synthesis when placed under conditions in which synthesis of a primer extension product that is complementary to a nucleic acid strand is induced, (e.g., in the presence of nucleotides and an inducing agent such as DNA polymerase and at a suitable temperature and pH). The primer is preferably single stranded for maximum efficiency in amplification, but may alternatively be double stranded. If double stranded, the primer is first treated to separate its strands before being used to prepare extension products. Preferably, the primer is an oligodeoxyribonucleotide. The primer must be sufficiently long to prime the synthesis of extension products in the presence of the inducing agent. The exact lengths of the primers will depend on many factors, including temperature, source of primer and the use of the method.

As used herein, the term "probe" refers to an oligonucleotide (e.g., a sequence of nucleotides), whether occurring naturally as in a purified restriction digest or produced synthetically, recombinantly, or by PCR amplification, that is capable of hybridizing to at least a portion of another oligonucleotide of interest. A probe may be single-stranded or double-stranded. Probes are useful in the detection, identification and isolation of particular gene sequences. It is contemplated that any probe used in the present invention will be labeled with any "reporter molecule," so that is detectable in any detection system, including, but not limited to enzyme (e.g., ELISA, as well as enzyme-based histochemical assays), fluorescent, radioactive, and luminescent systems. It is not intended that the present invention be limited to any particular detection system or label.

The terms "protein" and "polypeptide" refer to compounds comprising amino acids joined via peptide bonds and are used interchangeably. Conventional one and three-letter amino acid codes are used herein as follows—Alanine: Ala, A; Arginine: Arg, R; Asparagine: Asn, N; Aspartate: Asp, D; Cysteine: Cys, C; Glutamate: Glu, E; Glutamine: Gln, Q; Glycine: Gly, G; Histidine: His, H; Isoleucine: Ile, I; Leucine: Leu, L; Lysine: Lys, K; Methionine: Met, M; Phenylalanine: Phe, F; Proline: Pro, P; Serine: Ser, S; Threonine: Thr, T; Tryptophan: Trp, W; Tyrosine: Tyr, Y; Valine: Val, V. As used herein, the codes Xaa and X refer to any amino acid.

In some embodiments compounds of the technology comprise an antibody component or moiety, e.g., an antibody or fragments or derivatives thereof. As used herein, an "antibody", also known as an "immunoglobulin" (e.g., IgG, IgM, IgA, IgD, IgE), comprises two heavy chains linked to each other by disulfide bonds and two light chains, each of which is linked to a heavy chain by a disulfide bond. The specificity of an antibody resides in the structural complementarity between the antigen combining site of the antibody (or paratope) and the antigen determinant (or epitope). Antigen combining sites are made up of residues that are primarily from the hypervariable or complementarity determining regions (CDRs). Occasionally, residues from non-hypervariable or framework regions influence the overall domain structure and hence the combining site. Some embodiments comprise use of a fragment of an antibody, e.g., any protein or polypeptide-containing molecule that comprises at least a portion of an immunoglobulin molecule such as to permit specific interaction between said molecule and an antigen. The portion of an immunoglobulin molecule may include, but is not limited to, at least one complementarity determining region (CDR) of a heavy or light chain or a ligand binding portion thereof, a heavy chain or light chain variable region, a heavy chain or light chain constant region, a framework region, or any portion thereof. Such fragments may be produced by enzymatic cleavage, synthetic or recombinant techniques, as known in the art and/or as described herein. Antibodies can also be produced in a variety of truncated forms using antibody genes in which one or more stop codons have been introduced upstream of the natural stop site. The various portions of antibodies can be joined together chemically by conventional techniques, or can be prepared as a contiguous protein using genetic engineering techniques.

Fragments of antibodies include, but are not limited to, Fab (e.g., by papain digestion), F(ab')2 (e.g., by pepsin digestion), Fab' (e.g., by pepsin digestion and partial reduction) and Fv or scFv (e.g., by molecular biology techniques) fragments.

A Fab fragment can be obtained by treating an antibody with the protease papaine. Also, the Fab may be produced by inserting DNA encoding a Fab of the antibody into a vector for prokaryotic expression system or for eukaryotic expression system, and introducing the vector into a prokaryote or eukaryote to express the Fab. A F(ab')2 may be obtained by treating an antibody with the protease pepsin. Also, the F(ab')2 can be produced by binding a Fab' via a thioether bond or a disulfide bond. A Fab may be obtained by treating F(ab')2 with a reducing agent, e.g., dithiothreitol. Also, a Fab' can be produced by inserting DNA encoding a Fab' fragment of the antibody into an expression vector for a prokaryote or an expression vector for a eukaryote, and introducing the vector into a prokaryote or eukaryote for its expression. A Fv fragment may be produced by restricted cleavage by pepsin, e.g., at 4° C. and pH 4.0. (a method called "cold pepsin digestion"). The Fv fragment consists of the heavy chain variable domain (VH) and the light chain variable domain (VL) held together by strong noncovalent interaction. A scFv fragment may be produced by obtaining cDNA encoding the VH and VL domains as previously described, constructing DNA encoding scFv, inserting the DNA into an expression vector for prokaryote or an expression vector for eukaryote, and then introducing the expression vector into a prokaryote or eukaryote to express the scFv.

In general, antibodies can usually be raised to any antigen, using the many conventional techniques now well known in the art. Any antibody to an antigen which is found in sufficient concentration at a site in the body of a mammal which is of diagnostic or therapeutic interest can be used to make the compounds provided herein.

As used herein, the term "conjugated" refers to when one molecule or agent is physically or chemically coupled or adhered to another molecule or agent. Examples of conjugation include covalent linkage and electrostatic complexation. The terms "complexed," "complexed with," and "conjugated" are used interchangeably herein.

As used herein, the term "treatment" is defined as the application or administration of a therapeutic agent described herein, or identified by a method described herein, to a patient, or application or administration of the therapeutic agent to an isolated tissue or cell line from a patient, who has a disease, a symptom of disease or a predisposition toward a disease, with the purpose to cure, heal, alleviate, relieve, alter, remedy, ameliorate, improve or affect the disease, the symptoms of disease, or the predisposition toward disease.

The term "alkyl" shall mean straight or branched chain alkanes of one to ten total carbon atoms, or any number within this range (i.e., methyl, ethyl, 1-propyl, 2-propyl, n-butyl, s-butyl, t-butyl, etc.).

The term "aryl" as used herein, except where otherwise specifically defined, refers to unsubstituted, mono- or poly-substituted aromatic groups such as phenyl or naphthyl.

Unless otherwise specifically noted as only "unsubstituted" or only "substituted", defined groups are unsubstituted or substituted. Preferably, substituents are selected from the group that includes, but is not limited to, halo, $C_1$-$C_{20}$ alkyl, $CF_3$, $NH_2$, $N(C_1$-$C_6$ alkyl$)_2$, $NO_2$, oxo, CN, $N_3$, OH, O($C_1$-$C_6$ alkyl), $C_3$-$C_{10}$ cycloalkyl, $C_2$-$C_6$ alkenyl, $C_2$-$C_6$ alkynyl, ($C_0$-$C_6$ alkyl)S(O)$_{0-2}$, aryl-S(O)$_{0-2}$, ($C_0$-$C_6$ alkyl)S(O)$_{0-2}$($C_0$-$C_6$ alkyl), ($C_0$-$C_6$ alkyl)C(O)NH, $H_2N$—C(NH), O($C_1$-$C_6$ alkyl)$CF_3$, ($C_0$-$C_6$ alkyl)C(O), ($C_0$-$C_6$ alkyl)OC(O), ($C_0$-$C_6$ alkyl)O($C_1$-$C_6$ alkyl), ($C_0$-$C_6$ alkyl)C(O)$_{1-2}$($C_0$-$C_6$ alkyl), ($C_0$-$C_6$ alkyl)OC(O)NH, aryl, aralkyl, heteroaryl, heterocyclylalkyl, halo-aryl, halo-aralkyl, halo-heterocycle, halo-heterocyclylalkyl, cyano-aryl, cyano-aralkyl, cyano-heterocycle, and cyano-heterocyclylalkyl. The term "substituted" is understood to include mono- and poly-substitution by a named substituent to the extent such single and multiple substitution (including multiple substitution at the same site) is chemically allowed. Unless expressly stated to the contrary, substitution by a named substituent is permitted on any atom in a ring (e.g., aryl, a heteroaromatic ring, or a saturated heterocyclic ring) provided such ring substitution is chemically allowed and results in a stable compound.

A "stable" compound is a compound that can be prepared and isolated and whose structure and properties remain or can be caused to remain essentially unchanged for a period of time sufficient to allow use of the compound for the purposes described herein (e.g., therapeutic, prophylactic, and/or diagnostic administration to a subject).

As a result of the selection of substituents and substituent patterns, certain of the compounds of the present technology can have asymmetric centers and can occur as mixtures of stereoisomers, or as individual diastereomers, or enantiomers. All isomeric forms of these compounds, whether isolated or in mixtures, are within the scope of the present technology. Pharmaceutically acceptable salts include both the metallic (inorganic) salts and organic salts, a list of which is given in Remington's Pharmaceutical Sciences, 17th Edition, pg. 1418 (1985). It is well known to one skilled in the art that an appropriate salt form is chosen based on physical and chemical properties. As will be understood by those skilled in the art, pharmaceutically acceptable salts include, but are not limited to salts of inorganic acids such as hydrochloride, sulfate, phosphate, diphosphate, hydrobromide, and nitrate; or salts of an organic acid such as malate, maleate, fumarate, tartrate, succinate, citrate, acetate, lactate, methanesulfonate, p-toluenesulfonate or palmoate, salicylate, and stearate. Similarly pharmaceutically acceptable cations include, but are not limited to sodium, potassium, calcium, aluminum, lithium, and ammonium (especially ammonium salts with secondary amines). Also included within the scope of this technology are crystal forms, hydrates, and solvates.

Compositions according to the technology can be administered in the form of pharmaceutically acceptable salts. The term "pharmaceutically acceptable salt" refers to a salt that possesses the effectiveness of the parent compound and is not biologically or otherwise undesirable (e.g., is neither toxic nor otherwise deleterious to the recipient thereof). Suitable salts include acid addition salts that may, for example, be formed by mixing a solution of the compound of the present technology with a solution of a pharmaceutically acceptable acid such as hydrochloric acid, sulfuric acid, acetic acid, trifluoroacetic acid, or benzoic acid. Certain of the compounds employed in the present technology may carry an acidic moiety (e.g., COOH or a phenolic group), in which case suitable pharmaceutically acceptable salts thereof can include alkali metal salts (e.g., sodium or potassium salts), alkaline earth metal salts (e.g., calcium or magnesium salts), and salts formed with suitable organic ligands such as quaternary ammonium salts. Also, in the case of an acid (COOH) or alcohol group being present, pharmaceutically acceptable esters can be employed to modify the solubility or hydrolysis characteristics of the compound.

The term "administration" and variants thereof (e.g., "administering" a compound) in reference to a compound mean providing the compound or a prodrug of the compound to the individual in need of treatment or prophylaxis. When a compound of the technology or a prodrug thereof is provided in combination with one or more other active agents, "administration" and its variants are each understood to include provision of the compound or prodrug and other agents at the same time or at different times. When the agents of a combination are administered at the same time, they can be administered together in a single composition or they can be administered separately. As used herein, the term "composition" is intended to encompass a product comprising the specified ingredients in the specified amounts, as well as any product that results, directly or indirectly, from combining the specified ingredients in the specified amounts.

By "pharmaceutically acceptable" is meant that the ingredients of the pharmaceutical composition must be compatible with each other and not deleterious to the recipient thereof.

The term "subject" as used herein refers to an animal, preferably a mammal, most preferably a human, who has been the object of treatment, observation, or experiment.

As used herein, "child" refers to a subject at an age prior to biological development consistent with adulthood, e.g., from birth to an age of e.g., 12 years old to 18 years old for a human. As used herein, "child" also refers to a fetus and other stages of pre-natal development.

The term "effective amount" as used herein means that amount of active compound or pharmaceutical agent that elicits the biological or medicinal response in a cell, tissue, organ, system, animal, or human that is being sought by a researcher, veterinarian, medical doctor, or other clinician. In some embodiments, the effective amount is a "therapeutically effective amount" for the alleviation of the symptoms of the disease or condition being treated. In some embodiments, the effective amount is a "prophylactically effective amount" for prophylaxis of the symptoms of the disease or condition being prevented. The term also includes herein the amount of active compound sufficient to inhibit the mineralocorticoid receptor and thereby elicit a response being sought (e.g., an "inhibition effective amount"). When the active compound is administered as the salt, references to the amount of active ingredient are to the free form (the non-salt form) of the compound. In some embodiments, this amount is between 1 mg and 1000 mg per day, e.g., between 1 mg and 500 mg per day (between 1 mg and 200 mg per day).

In the method of the present technology, compounds, optionally in the form of a salt, can be administered by any means that produces contact of the active agent with the agent's site of action. They can be administered by any conventional means available for use in conjunction with pharmaceuticals, either as individual therapeutic agents or in a combination of therapeutic agents. They can be administered alone, but typically are administered with a pharmaceutical carrier selected on the basis of the chosen route of administration and standard pharmaceutical practice. The compounds of the technology can, for example, be administered orally, parenterally (including subcutaneous injections, intravenous, intramuscular, intrasternal injection, or infusion techniques), by inhalation spray, or rectally, in the form of a unit dosage of a pharmaceutical composition containing an effective amount of the compound and conventional non-toxic pharmaceutically-acceptable carriers, adjuvants, and vehicles. Liquid preparations suitable for oral administration (e.g., suspensions, syrups, elixirs, and the like) can be prepared according to techniques known in the art and can employ any of the usual media such as water, glycols, oils, alcohols, and the like. Solid preparations suitable for oral administration (e.g., powders, pills, capsules, and tablets) can be prepared according to techniques known in the art and can employ such solid excipients as starches, sugars, kaolin, lubricants, binders, disintegrating agents, and the like. Parenteral compositions can be prepared according to techniques known in the art and typically employ sterile water as a carrier and optionally other ingredients, such as a solubility aid. Injectable solutions can be prepared according to methods known in the art wherein the carrier comprises a saline solution, a glucose solution, or a solution containing a mixture of saline and glucose. Further description of methods suitable for use in preparing pharmaceutical compositions for use in the present technology and of ingredients suitable for use in said compositions is provided in Remington's Pharmaceutical Sciences, 18th edition, edited by A. R. Gennaro, Mack Publishing Co., 1990. Compounds of the present technology can be made by a variety of methods depicted in the synthetic reaction schemes provided herein. The starting materials and reagents used in preparing these compounds generally are either available from commercial suppliers, such as Aldrich Chemical Co., or are prepared by methods known to those skilled in the art following procedures set forth in references such as Fieser and Fieser's Reagents for Organic Synthesis, Wiley & Sons: New York, Volumes 1-21; R. C. LaRock, Comprehensive Organic Transformations, 2nd edition Wiley-VCH, New York 1999; Comprehensive Organic Synthesis, B. Trost and I. Fleming (Eds.) vol. 1-9 Pergamon, Oxford, 1991; Comprehensive Heterocyclic Chemistry, A. R. Katritzky and C. W. Rees (Eds) Pergamon, Oxford 1984, vol. 1-9; Comprehensive Heterocyclic Chemistry II, A. R. Katritzky and C. W. Rees (Eds) Pergamon, Oxford 1996, vol. 1-11; and Organic Reactions, Wiley & Sons: New York, 1991, Volumes 1-40. The synthetic reaction schemes and examples provided herein are merely illustrative of some methods by which the compounds of the present technology can be synthesized, and various modifications to these synthetic reaction schemes can be made and will be suggested to one skilled in the art having referred to the disclosure contained in this application.

The starting materials and the intermediates of the synthetic reaction schemes can be isolated and purified if desired using conventional techniques, including but not limited to, filtration, distillation, crystallization, chromatography, and the like. Such materials can be characterized using conventional means, including physical constants and spectral data.

Description

Although the disclosure herein refers to certain illustrated embodiments, it is to be understood that these embodiments are presented by way of example and not by way of limitation.

Compositions

In some embodiments, the technology relates to compositions comprising a bioactive agent that modulates the activity of a biological molecule that mediates aberrant axonal growth. In some embodiments, the bioactive agent is a drug or pharmaceutical compound. In some embodiments, the modulating is an increase and in some embodiments the modulating is a decrease. In some embodiments, the biological molecule is a protein, DNA, RNA, cofactor, hormone, or other signaling molecule. In some embodiments, the activity of the biological molecule is a phosphorylation (e.g., kinase) activity, a dephosphorylation activity, a protease activity, an allosteric activity, an inhibiting activity, an activating activity, etc. In some embodiments, the aberrant axonal growth is associated with a neurological malady such as Down syndrome, epilepsy, bipolar disorder, and fragile X mental retardation.

In particular embodiments, the biological molecule mediates the effects of another biological molecule that has an aberrant expression, aberrant activity, and/or is dysregulated (e.g., a dysregulated biological molecule). In some embodiments, dysregulation is an abnormally high activity of the dysregulated biological molecule and in some embodiments dysregulation is an abnormally low activity of the dysregulated biological molecule. In some embodiments, dysregulation is temporal dysregulation (e.g., expression and/or activity of the dysregulated biological molecule at an abnormal time, e.g., at an abnormal time in a biological developmental program). In some embodiments, the dysregulation is spatial dysregulation (e.g., expression and/or activity of the dysregulated biological molecule at the wrong location, e.g., at an abnormal location in a biological organism, e.g., in the wrong cell, tissue, organ, etc.). In some embodiments, dysregulation comprises one or more of abnormally high activity, abnormally low activity, temporal dysregulation, and/or spatial dysregulation.

For example, in some embodiments, the dysregulated molecule is Dscam (or a homolog, paralog, and/or ortholog of Dscam) and the type of dysregulation is overexpression and/or an abnormally high activity of Dscam. Down Syndrome Cell Adhesion Molecule ("Dscam", denoting the Dscam protein) is encoded by the DSCAM gene. Down syndrome, caused by trisomy 21, is a common birth defect associated with mental retardation. Another DSCAM-like gene, DSCAML1, is located on chromosome 11 (e.g., at band 11q23) at a locus associated with Gilles de la Tourette and Jacobsen syndromes.

DSCAM is predicted to be a transmembrane protein with a very high structural and sequence homology to the immunoglobulin (Ig) superfamily of cell adhesion molecules. Dscam expression is dynamically regulated in developing mouse brains (see, e.g., Maynard and Stein (2012) "DSCAM Contributes to Dendrite Arborization and Spine Formation in the Developing Cerebral Cortex" *J. Neuroscience.* 32: 16637-16650). Dscam protein levels peak at postnatal day 7 to 10 in the cerebral cortex, coinciding with a period of extensive axonal branching (see, e.g., Larsen and Callaway (2006) "Development of layer-specific axonal arborizations in mouse primary somatosensory cortex" *Journal of Comparative Neurology* 494: 398-414), and decreases after postnatal day 10.

The *Drosophila melanogaster* Dscam has 24 exons; exon 4 has 12 variants, exon 6 has 48 variants, exon 9 has 33 variants, and exon 17 has two variants. The combination of exons 4, 6, and 9 leads to 19,008 possible isoforms with different extracellular domains (due to differences in Ig2, Ig3 and Ig4). With two different transmembrane domains from exon 17, the total possible protein products could reach 38,016 isoforms. These isoforms have different specific interactions due to structural variability. The diversity of isoforms from alternative splicing of the Dscam (e.g., Dscam1) gene in *D. melanogaster* allows every neuron in the fly to display a unique set of Dscam proteins on its cell surface. Dscam interaction stimulates self-avoidance mechanisms that are essential for normal neural circuit development.

In addition to the numerous isoforms that arise from alternative splicing of a single DSCAM gene of one species, DSCAM also has homologs in a number of species, e.g., with similarities at the gene, mRNA transcript, and/or protein level (Table 1).

TABLE 1

Homologs of Down Syndrome Adhesion Molecule.

| Species | Gene name | Gene NCBI accession | mRNA NCBI accession | Protein NCBI accession |
|---|---|---|---|---|
| H. sapiens | DSCAM | NC_000021.8 | NM_001389.3 | NP_001380.2 |
| P. troglodytes | DSCAM | NC_006488.2 | XM_001171538.1 | XP_001171538.1 |
| M. mulatta | DSCAM | NC_007860.1 | XM_002803124.1 | XP_002803170.1 |
| C. lupus | DSCAM | NC_006613.3 | XM_544893.3 | XP_544893.3 |
| B. taurus | DSCAM | AC_000158.1 | XM_002685111.2 | XP_002685157.1 |
| M. musculus | Dscam | NC_000082.6 | NM_031174.4 | NP_112451.1 |
| R. norvegicus | Dscam | NC_005110.3 | NM_133587.1 | NP_598271.1 |
| G. gallus | DSCAM | NC_006088.3 | XM_416734.3 | XP_416734.3 |
| D. rerio | dscam | NC_007121.5 | NM_001030224.1 | NP_001025395.1 |
| D. melanogaster | Dscam, CG42330 | NT_033778.3 | NM_001043131.2 | NP_001036596.2 |
| A. gambiae | AgaP_AGAP007092 | | XM_308666.4 | XP_308666.4 |

Sequences referenced by NCBI accession numbers (and complements, revisions (e.g., point and other revisions), updates, mutants, substituted forms, and variants thereof) are herein incorporated by reference.

Human DSCAM (also known as CHD2-42; CHD2-52) is present at positions 41,384,343 to 42,219,039 on chromosome 21 (in particular, at 21q22.2) (SEQ ID NO: 1). Little is known of the role of Dscam in human development and disease. While knowledge of the mechanism that links Dscam activity to neurological defects is not required to practice the technology and without being bound by theory, it is contemplated that genetic aberrations at or near the DSCAM gene produce the physical aberration associated with Down syndrome and other neurological maladies. In particular, DSCAM maps to chromosome 21 in a region critical for the neurocognitive and other defects of Down syndrome and DSCAML1 (a DSCAM homolog) maps to chromosome 11 in a region whose deletion is associated with 11q deletion syndrome. It is contemplated that these aberrations give rise to neurocognitive defects and a subset of other defects which are similar to those seen in Down syndrome, including psychomotor retardation, Strabismus, Epicanthus, Telecanthus, carp-shaped upper lip, low-set dysmorphic ears, and cardiac defects. Furthermore, mutations in Dscam are associated with autism spectrum disorder (see, e.g., Iossifov et al (2014) "The contribution of de novo coding mutations to autism spectrum disorder" Nature 515: 216).

Previous research has indicated that the level of DSCAM expression is increased (e.g., by more than 20%, e.g., 20%, 25%, 30%, 35%, 40%, 45%, 50%, 55% or more) in the Down syndrome brain. In particular, research indicated that Dscam expression levels control the development of axon terminals (also called synaptic terminals or presynaptic arbor). Two converging pathways, one comprising dual leucine zipper kinase (DLK) and the second comprising fragile X mental retardation protein (FMRP), control Dscam expression through protein translation. Defects in the regulation of Dscam lead to abnormal (e.g., excessive) axon terminal growth in Drosophila somatosensory neurons. Accordingly, it is contemplated that the function of Dscam in axon size control indicates that aberrant and/or dysregulated expression and/or activity of Dscam contributes to the pathogenesis of neurological disorders.

In addition, DSCAM may interact with other genes to produce defects in the circulatory system (e.g., congenital heart defects). For instance, over-expressing DSCAM and COL6A2 in Drosophila and murine heart produced a high mortality rate in addition to several serious heart defects, including atrial septal defects and cardiac hypertrophy. The interaction between DSCAM and COL6A2 and their combined effects were also observed in the H9c2 cardiac cell line with incidence of cardiac hypertrophy. (Grossman et al (2011). "Over-expression of DSCAM and COL6A2 cooperatively generates congenital heart defects" PLoS Genetics 7 (11): e1002344). As such, DSCAM exerts a synergistic with other interactors to produce symptoms of cardiac disease.

Figure 8:
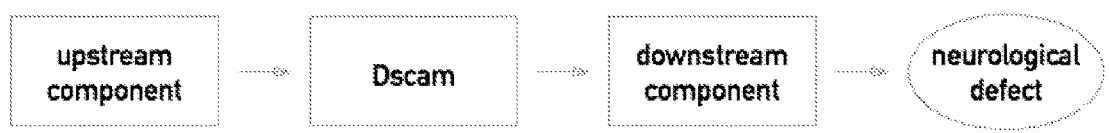
FIG. 8 is a schematic of a biological pathway comprising Dscam.

During the development of embodiments of the technology provided herein, experiments indicated that the effects of Dscam (e.g., to produce neurological defects when overexpressed or over-active) are mediated and/or modulated by other biological molecules. For instance, in one model, a biological pathway exists—comprising Dscam and other biological components—that is associated with neuronal function and development. In such a model, the effects of Dscam are mediated by components downstream of Dscam that "transmit" the effect of Dscam to produce phenotypes associated with neuronal function and development. In another model, the effects of Dscam are mediated by components upstream of Dscam that can modulate the activity and/or expression of Dscam. Accordingly, in such a model the overexpression and/or aberrant (e.g., increased) activity of Dscam depends on the downstream component (e.g., mediator) to produce the neurological defect. In addition, in some models the action of an upstream component acts to induce the overexpression and/or aberrant (e.g., increased) activity of Dscam and/or the action of an upstream component acts to suppress the overexpression and/or aberrant (e.g., increased) activity of Dscam (see, e.g., FIG. 8). In some models, Dscam interacts with other biological molecules to form a complex. As such, aberrant Dscam expression and/or activity is counteracted by modulating the biological molecule that forms a complex with Dscam.

In particular, experiments conducted during the development of the technology described herein identified the Abelson murine leukemia viral oncogene homolog 1 (Abl) kinase as a mediator of effects (e.g., aberrant axonal growth) caused by aberrant (e.g., increased) expression of Dscam. Abl is a protein that, in humans, is encoded by the ABL1 gene located on chromosome 9 (see, e.g., NCBI sequence at accession NG_012034.1). c-Abl is sometimes used to refer to the version of the gene found within the mammalian genome and v-Abl is used to refer to the viral gene. The ABL1 gene is a proto-oncogene that encodes a cytoplasmic and nuclear protein tyrosine kinase that has been implicated in processes of cell differentiation, cell division, cell adhesion, and stress response. Activity of ABL1 protein is negatively regulated by its SH3 domain and deletion of the SH3 domain turns ABL1 into an oncogene. The t(9;22) translocation results in the head-to-tail fusion of the BCR and ABL1 genes, leading to a fusion gene present in many cases of chronic myelogenous leukemia. The DNA-binding activity of the ubiquitously expressed ABL1 tyrosine kinase is regulated by CDC2-mediated phosphorylation, suggesting a cell cycle function for ABL1. The ABL1 gene is expressed as either a 6- or a 7-kb mRNA transcript, with alternatively spliced first exons spliced to the common exons 2-11.

In addition to the human ABL1 gene and Abl protein, ABL1 and Abl have homologs in a number of species, e.g., with similarities at the gene, mRNA transcript, and/or protein level (Table 2).

TABLE 2

Homologs of Abelson Tyrosine Kinase.

| Species | Gene name | Gene NCBI accession | mRNA NCBI accession | Protein NCBI accession |
|---|---|---|---|---|
| H. sapiens | ABL1 | NC_000009.11 | NM_005157.4 | NP_005148.2 |
| P. troglodytes | ABL1 | NC_006476.3 | XM_001166213.3 | XP_001166213.2 |
| M. mulatta | ABL1 | NC_007872.1 | XM_001118598.2 | XP_001118598.2 |
| C. lupus | ABL1 | NC_006591.3 | XM_548413.4 | XP_548413.3 |
| B. taurus | ABL1 | AC_000168.1 | NM_001206860.1 | NP_001193789.1 |
| M. musculus | Abl1 | NC_000068.7 | NM_001112703.2 | NP_001106174.1 |
| R. norvegicus | Abl1 | NC_005102.3 | NM_001100850.1 | NP_001094320.1 |
| G. gallus | ABL1 | NC_006104.3 | XM_001233811.3 | XP_001233812.1 |
| D. rerio | Abl1 | NC_007116.5 | XM_001337793.5 | XP_001337829.1 |
| D. melanogaster | Abl, CG4032 | NT_037436.3 | NM_080104.3 | NP_524843.2 |
| A. gambiae | AgaP_AGAP004989 | | XM_315093.4 | XP_315093.4 |

Sequences referenced by NCBI accession numbers (and complements, revisions (e.g., point and other revisions), updates, mutants, substituted forms, and variants thereof) are herein incorporated by reference.

Mutations in the ABL1 gene are associated with chronic myelogenous leukemia (CML). In CML, the gene is activated by being translocated within the BCR (breakpoint cluster region) gene on chromosome 22. This new fusion gene, BCR-ABL, encodes an unregulated, cytoplasm-targeted tyrosine kinase that allows the cells to proliferate without being regulated by cytokines. This, in turn, allows the cell to become cancerous.

The BCR-ABL protein (e.g., the Abl tyrosine kinase) is inhibited by various small molecules. One such inhibitor is imatinib mesylate, which occupies the tyrosine kinase domain and inhibits BCR-ABL's influence on the cell cycle. Second generation BCR-ABL tyrosine-kinase inhibitors are also under development to inhibit BCR-ABL mutants resistant to imatinib. There is some evidence that the expression of Abl is regulated by the microRNA miR-203 (see, e.g., Bueno et al (2008). "Genetic and epigenetic silencing of microRNA-203 enhances ABL1 and BCR-ABL1 oncogene expression" Cancer Cell 13: 496).

Compounds have been developed that selectively inhibit the Abl tyrosine kinase. Some of these compounds are adenosine triphosphate (ATP)-competitive inhibitors. Busulfan, hydroxyurea, and interferon-alpha (IFN-$\alpha$) are other known inhibitors of Abl tyrosine kinase. Further, Imatinib (Gleevec) is a known inhibitor of Abl tyrosine kinase and has been used as a first-generation drug, e.g., in the treatment of CML. Results of many patient studies support the treatment of children with Abl inhibitors such as imatinib. Imatinib mesylate is generally well tolerated in children, with adverse effects usually being mild to moderate and quickly reversible with treatment discontinuation or dose reduction (see, e.g., Millot F et al. (2011) "Imatinib is effective in children with previously untreated chronic myelogenous leukemia in early chronic phase: results of the French national phase IV trial" *J Clin Oncol* 29(20): 2827-32; Champagne et al. (2011) "Higher dose imatinib for children with de novo chronic phase chronic myelogenous leukemia: a report from the Children's Oncology Group" *Pediatr Blood Cancer* 57(1): 56-62. Further, imatinib has been used to treat young child patients (e.g., as young as 12 months old) and is a frontline therapy for pediatric CML in chronic phase (see, e.g., Andolina et al (2012) "How I treat childhood CML" *Blood* 119(8)1821-30).

Second generation Abl tyrosine kinase inhibitors have decreased resistance and intolerance relative to imatinib. Second generation drugs that are currently marketed are nilotinib, dasatinib, bosutinib, and ponatinib.

Nilotinib is a phenylamino-pyrimidine derivative (4-methyl-N-[3-(4-methyl-1-H-imidazol-1-yl)-5-(trifluoromethyl)phenyl]-3-[(4-pyridin-3-ylpyrimidin-2-yl) amino] benzamide) that is structurally related to imatinib. Nilotinib is an Abl kinase inhibitor that is 10-fold to 30-fold more potent than imatinib in inhibiting the activity of the Abl tyrosine kinase. Synergistic activity of imatinib and nilotinib has been reported following coadministration. Without being bound by theory, it is contemplated that the synergistic effects result from the different mechanisms by which imatinib and nilotinib enter the cell cytoplasm—in particular, imatinib influx is dependent on OCT1 but nilotinib is not. Moreover, nilotinib is also not a substrate for the efflux transporter P-glycoprotein pump, unlike imatinib.

As used to treat cancer patients, nilotinib is taken as a capsule by mouth on an empty stomach (e.g., at least 2 hours after eating, at least 1 hour before eating). The usual starting dose is 300 mg to 500 mg (e.g., 400 mg) taken twice a day, e.g., about 12 hours apart. The technology contemplates other doses that are effective in treating subjects having aberrant and/or dysregulated Dscam expression and/or activity. A pediatric phase I trial is assessing treatment of children with CML or Philadelphia chromosome-positive ALL with nilotinib. The pharmacological half-life in a human is approximately 15 to 17 hours and bioavailability is approximately 30% (e.g., producing approximately 100-150 mg in the body). It is estimated that the concentration nilotinib in a human is approximately 1.3 $\mu$mol/liter (e.g., approximately 1.3 $\mu$M).

Dasatinib is a thiazolylaminopyrimidine that is 325-fold more potent against cells expressing wild type Abl than imatinib. Dasatinib is a multi-targeted inhibitor of Abl and Src family kinases. It also has inhibitory activity against additional downstream kinases. Dasatinib exhibits increased potency but reduced selectivity compared to imatinib. Dasatinib binds the active conformation of Abl kinase, contrary to most tyrosine kinase inhibitors. Since dasatinib is an inhibitor of Src family kinases, it can overcome resistance due to Src family kinase activation. Because it does not bind to Bcr-Abl with the same stringent conformational requirements as imatinib, it can inhibit Abl kinase domain mutants. Dasatinib is also not a substrate of multidrug P-glycoprotein efflux pumps like imatinib. Because of this dasatinib may be active in some patients after failure with both imatinib and nilotinib. A pediatric clinic trial study of dasatinib showed good tolerance for dasatinib in children, e.g., at doses used to treat adults with CML (see, e.g., Aplenc et al. (2011) "Pediatric phase I trial and pharmacokinetic study of dasatinib: a report from the children's oncology group phase I consortium" *J Clin Oncol* 29(7): 839-44).

Bosutinib is an Abl kinase inhibitor that also inhibits Src and a wide range of both tyrosine and serine-threonine kinases. Ponatinib (AP24534) is an orally active Abl tyrosine kinase inhibitor. Bafetinib has more affinity for Abl than nilotinib (but less than dasatinib) and targets specifically Abl and the Src family kinases Lck and Lyn. Finally, research indicates that 1,3,4 thiadiazole derivatives have activity against Abl kinase.

Accordingly, the technology provides compositions comprising agents (e.g., drugs, pharmaceutical compositions, small molecules, nucleic acids, etc.) that modulate the activity of a biological component associated with the functions and/or dysfunctions of Dscam, e.g., physiological components that can be modulated to counteract aberrant Dscam expression and/or activity.

For example, data were collected that establish (Abl) kinase as a mediator of effects caused by increased expression and/or activity of Dscam. Accordingly, the technology described provides, inter alia, the therapeutic use of Abl kinase inhibitors to treat neurological and mental disorders associated with aberrant and/or dysregulated Dscam expression and/or activity. Thus, in some embodiments, the technology provides a composition comprising a kinase inhibitor, e.g., a tyrosine kinase inhibitor, e.g., an Abl kinase inhibitor such as imatinib, nilotinib, dasatinib, bosutinib, bafetinib, and/or ponatinib. In some embodiments, compositions comprise one or more of imatinib, nilotinib, dasatinib, bosutinib, bafetinib, and/or ponatinib, e.g., such that they work together to provide an additive and/or synergistic effect.

The technology is not limited in the agents (e.g., drugs, pharmaceutical compositions, small molecules, nucleic acids, etc.) that modulate the activity of a biological component associated with the functions and/or dysfunctions of Dscam, e.g., a biological component that can be modulated to counteract aberrant Dscam expression and/or activity. While imatinib, nilotinib, dasatinib, bosutinib, bafetinib, and ponatinib are provided as illustrative examples, the technology contemplates any extant or yet-discovered agent (e.g., drugs, pharmaceutical compositions, small molecules, nucleic acids, etc.) that modulates the activity of a biological component associated with the functions and/or dysfunctions of Dscam, e.g., biological components that can be modulated to counteract aberrant Dscam expression and/or activity (e.g., biological components that form a complex with Dscam, biological components that are in a pathway with Dscam, and/or biological components that are otherwise involved at least partially in producing, mediating, transmitting, etc. a neurological phenotype associated with aberrant Dscam expression and/or activity).

In addition, while the experiments identified Abl as an actor associated with Dscam and tested the effects of nilotinib on Abl kinase activity, the technology contemplates other biological components associated with the functions and/or dysfunctions of Dscam, e.g., biological components that can be modulated to counteract aberrant Dscam expression and/or activity, and other agents (e.g., drugs, pharmaceutical compositions, small molecules, nucleic acids, etc.) that modulate the activity of such a biological component associated with Dscam. In some embodiments, the agent does not affect Dscam expression and/or activity. The technology also contemplates combinations (e.g., two or more) of such agents.

Antibodies

In some embodiments, the technology relates to compositions comprising an antibody (or an antibody fragment, derivative, or similar molecule, e.g., as described herein or as known in the art) to modulate the activity or expression of a biological component associated with the functions and/or dysfunctions of Dscam, e.g., a biological component that can be modulated to counteract aberrant Dscam expression and/or activity.

For instance, in some embodiments, the technology relates to compositions comprising an antibody (or an antibody fragment, derivative, or similar molecule, e.g., as described herein or as known in the art) to modulate the activity or expression of a biological component acting upstream of Dscam. In some embodiments, the technology relates to compositions comprising an antibody (or an antibody fragment, derivative, or similar molecule, e.g., as described herein or as known in the art) to modulate the activity or expression of a biological component acting downstream of Dscam. In some embodiments, the technology relates to compositions comprising an antibody (or an antibody fragment, derivative, or similar molecule, e.g., as described herein or as known in the art) to modulate the activity or expression of a biological component that binds to Dscam. In some embodiments, the technology relates to compositions comprising an antibody (or an antibody fragment, derivative, or similar molecule, e.g., as described herein or as known in the art) to modulate the activity or expression of Dscam.

For example, the antibody can be a monoclonal antibody or a polyclonal antibody, and may be, for example, a human, humanized, or chimeric antibody. Monoclonal antibodies against target antigens are produced by a variety of techniques including conventional monoclonal antibody methodologies such as the somatic cell hybridization techniques of Köhler and Milstein (Nature, 256:495 (1975)). Although in some embodiments, somatic cell hybridization procedures are preferred, other techniques for producing monoclonal antibodies are contemplated as well (e.g., viral or oncogenic transformation of B lymphocytes).

It is contemplated that an antibody against Dscam or an antibody against a biological component associated with the functions and/or dysfunctions of Dscam (e.g., a biological component that can be modulated to counteract aberrant Dscam expression and/or activity, e.g., Abl kinase) finds use in the experimental, diagnostic, and therapeutic methods described herein. In certain embodiments, the antibodies provided herein are used to detect the expression of Dscam or a biological component associated with the functions and/or dysfunctions of Dscam (e.g., a biological component that can be modulated to counteract aberrant Dscam expression and/or activity, e.g., Abl kinase) in biological samples. For example, a sample comprising a tissue biopsy can be sectioned and protein detected using, for example, immunofluorescence or immunohistochemistry. Alternatively, individual cells from a sample can be isolated and protein expression detected on fixed or live cells by FACS analysis. Furthermore, the antibodies can be used on protein arrays to detect expression of Dscam or a biological component associated with the functions and/or dysfunctions of Dscam (e.g., a biological component that can be modulated to counteract aberrant Dscam expression and/or activity, e.g., Abl kinase). In other embodiments, the antibodies provided herein are used to modulate the activity or expression of Dscam or are used to modulate the activity or expression of a biological component associated with the functions and/or dysfunctions of Dscam (e.g., a biological component that can be modulated to counteract aberrant Dscam expression and/or activity, e.g., Abl kinase) either in an in vitro cell-based assay or in an in vivo animal model. In some embodiments, antibodies are used to treat a human patient by administering a therapeutically effective amount of an antibody against Dscam or by administering a therapeutically effective amount of an antibody against a biological component associated with the functions and/or dysfunctions of Dscam (e.g., a biological component that can be modulated to counteract aberrant Dscam expression and/or activity, e.g., Abl kinase).

For the production of antibodies, various host animals can be immunized by injection with the peptide corresponding to the desired epitope (e.g., a translation product of a sequence provided by SEQ ID NO: 1 or immunogenic portions thereof; a translation product of a sequence provided by SEQ ID NO: 2 or immunogenic portions thereof) including, but not limited to, rabbits, mice, rats, sheep, goats, etc. In some embodiments, the peptide comprises a sequence provided by a polypeptide referenced by the accession numbers in Table 1 or a polypeptide translated from the accession numbers in Table 1 or in Table 2. In some embodiments, the polypeptide comprises a sequence of the human protein encoded by the ABL1 gene, e.g., Abl (e.g., c-Abl) kinase, e.g., a polypeptide comprising a sequence provided by NCBI accession number NP_005148.2 (isoform a) or NP_009297.2 (isoform b) or a translation product of the mRNA having a sequence provided by NCBI accession number NM_005157.4 (isoform a) or NM_007313.2 (isoform b). The technology also contemplates mutants (e.g., substitutions, deletions, insertions, or other changes), substituted variants, domain-swapped variants, circularly permuted variants, homologs (e.g., orthologs, paralogs), truncated forms, codon-optimized forms, fusions, etc. of these nucleotide and polypeptide sequences, as long as said variant produces an antibody specific for Dscam, an antibody specific for a biological component upstream of Dscam, and/or an antibody specific for a biological component associated with the functions and/or dysfunctions of Dscam (e.g., a biological component that can be modulated to counteract aberrant Dscam expression and/or activity, e.g., Abl kinase).

In some embodiments, the peptide is conjugated to an immunogenic carrier (e.g., diphtheria toxoid, bovine serum albumin (BSA), or keyhole limpet hemocyanin (KLH)). Various adjuvants are used to increase the immunological response, depending on the host species, including, but not limited to, Freund's (complete and incomplete), mineral gels such as aluminum hydroxide, surface active substances such as lysolecithin, pluronic polyols, polyanions, peptides, oil emulsions, keyhole limpet hemocyanins, dinitrophenol, and potentially useful human adjuvants such as BCG (Bacille Calmette-Guerin) and *Corynebacterium parvum*.

Polyclonal antibodies can be prepared by any known method. Polyclonal antibodies can be raised by immunizing an animal (e.g., a rabbit, rat, mouse, donkey, etc) by multiple subcutaneous or intraperitoneal injections of the relevant antigen (a purified peptide fragment, full-length recombinant protein, fusion protein, etc.) optionally conjugated to KLH, serum albumin, etc., diluted in sterile saline, and combined with an adjuvant to form a stable emulsion. The polyclonal antibody is then recovered from blood, ascites, and the like, of an animal so immunized. Collected blood is clotted, and the serum decanted, clarified by centrifugation, and assayed for antibody titer. The polyclonal antibodies can be purified from serum or ascites according to standard methods in the art including affinity chromatography, ion-exchange chromatography, gel electrophoresis, dialysis, etc.

For preparation of monoclonal antibodies, any technique that provides for the production of antibody molecules by continuous cell lines in culture may be used (see e.g., Harlow and Lane, Antibodies: A Laboratory Manual, Cold Spring Harbor Laboratory Press, Cold Spring Harbor, N.Y.). These include, but are not limited to, the hybridoma technique originally developed by Köhler and Milstein and the trioma technique, the human B-cell hybridoma technique (See, e.g., Kozbor et al., Immunol. Today, 4:72 (1983)), and the EBV-hybridoma technique to produce human monoclonal antibodies (Cole et al., in Monoclonal Antibodies and Cancer Therapy, Man R. Liss, Inc., pp. 77-96 (1985)).

In some embodiments provided herein, the antibodies are prepared from a hybridoma. Using the hybridoma method, a mouse, hamster, or other appropriate host animal, is immunized as described above to elicit the production by lymphocytes of antibodies that will specifically bind to an immunizing antigen. Alternatively, lymphocytes can be immunized in vitro. Following immunization, the lymphocytes are isolated and fused with a suitable myeloma cell line using, for example, polyethylene glycol, to form hybridoma cells that can then be selected away from unfused lymphocytes and myeloma cells. Hybridomas that produce monoclonal antibodies directed specifically against a chosen antigen as determined by immunoprecipitation, immunoblotting, or by an in vitro binding assay such as radioimmunoassay (RIA) or enzyme-linked immunosorbent assay (ELISA) can then be propagated in vitro (e.g., in culture) using standard methods (Goding, Monoclonal Antibodies: Principles and Practice, Academic Press, 1986) or in vivo as ascites tumors in an animal. The monoclonal antibodies can then be purified from the culture medium or ascites fluid as described for polyclonal antibodies above.

The preferred animal system for preparing hybridomas is the murine system. Hybridoma production in the mouse is a well-established procedure. Immunization protocols and techniques for isolation of immunized splenocytes for fusion are known in the art. Fusion partners (e.g., murine myeloma cells) and fusion procedures are also known. For example, embodiments of the technology herein provide monoclonal antibodies produced from a hybridoma prepared by immunizing mice with a peptide corresponding to the desired epitope (e.g., a translation product of a sequence provided by SEQ ID NO: 1 or immunogenic portions thereof; a translation product of a sequence provided by SEQ ID NO: 2 or immunogenic portions thereof). In some embodiments, the peptide comprises a sequence provided by a polypeptide referenced by the accession numbers in Table 1 or a polypeptide translated from the accession numbers in Table 1. In some embodiments, the polypeptide comprises a sequence of the human protein encoded by the ABL1 gene, e.g., Abl (e.g., c-Abl) kinase, e.g., a polypeptide comprising a sequence provided by NCBI accession number NP_005148.2 (isoform a) or NP_009297.2 (isoform b) or a translation product of the mRNA having a sequence provided by NCBI accession number NM_005157.4 (isoform a) or NM_007313.2 (isoform b). In some embodiments, the peptide comprises a sequence provided by a polypeptide referenced by the accession numbers in Table 2 or a polypeptide translated from the accession numbers in Table 2.

The technology also contemplates mutants (e.g., substitutions, deletions, insertions, or other changes), substituted variants, domain-swapped variants, circularly permuted variants, homologs (e.g., orthologs, paralogs), truncated forms, codon-optimized forms, fusions, etc. of these nucleotide and polypeptide sequences, as long as said variant produces an antibody specific for Dscam or an antibody specific for a biological component associated with the functions and/or dysfunctions of Dscam (e.g., a biological component that can be modulated to counteract aberrant Dscam expression and/or activity, e.g., Abl kinase).

Producing polypeptides can be accomplished according to various techniques well known in the art. For example, a polypeptide comprising a sequence provided by NCBI accession number NP_005148.2 (isoform a) or NP_009297.2 (isoform b) can be produced using a bacterial expression system and a nucleic acid encoding the polypeptide, e.g., a nucleic acid having a sequence provided by NCBI accession number NM_005157.4 (isoform a) or NM_007313.2 (isoform b). Furthermore, a polypeptide comprising a polypeptide sequence provided by the accession numbers of Table 1 or table 2 can be produced using a bacterial expression system and a nucleic acid encoding the polypeptide, e.g., a nucleic acid having a sequence provided by the accession numbers of Table 1 or Table 2.

Moreover, human monoclonal antibodies directed against human proteins can be generated using transgenic mice carrying the complete human immune system rather than the mouse system. Splenocytes from the transgenic mice are immunized with the antigen of interest, which are used to produce hybridomas that secrete human monoclonal antibodies with specific affinities for epitopes from a human protein.

Monoclonal antibodies can also be generated by other methods known to those skilled in the art of recombinant DNA technology. For instance, combinatorial antibody display has can be utilized to produce monoclonal antibodies (see, e.g., Sastry et al., Proc. Nat. Acad. Sci. USA, 86: 5728 (1989); Huse et al., Science, 246: 1275 (1989); Orlandi et al., Proc. Nat. Acad. Sci. USA, 86:3833 (1989)). After immunizing an animal with an immunogen as described above, the antibody repertoire of the resulting B-cell pool is cloned. Methods are generally known for obtaining the DNA sequence of the variable regions of a diverse population of immunoglobulin molecules by using a mixture of oligomer primers and PCR. For instance, mixed oligonucleotide primers corresponding to the 5' leader (signal peptide) sequences and/or framework 1 (FR1) sequences, as well as primers to a conserved 3' region can be used to amplify and isolate the heavy and light chain variable regions from a number of murine antibodies (see, e.g., Larrick et al., Biotechniques, 11: 152 (1991)). A similar strategy can also been used to amplify human heavy and light chain variable regions from human antibodies (see, e.g., Larrick et al., Methods: Companion to Methods in Enzymology, 2: 106 (1991)).

Alternatively, monoclonal antibodies can also be made using recombinant DNA methods as described in U.S. Pat. No. 4,816,567. The polynucleotides encoding a monoclonal antibody are isolated (e.g., from mature B-cells or hybridoma cells), by, e.g., RT-PCR using oligonucleotide primers that specifically amplify the genes encoding the heavy and light chains of the antibody, and their sequences are determined using conventional procedures. The isolated polynucleotides encoding the heavy and light chains are then cloned into suitable expression vectors, which, when transfected into host cells such as E. coli cells, simian COS cells, Chinese hamster ovary (CHO) cells, or myeloma cells that do not otherwise produce immunoglobulin protein, cause monoclonal antibodies to be generated by the host cells. Also, recombinant monoclonal antibodies or fragments thereof of the desired species can be isolated from phage display libraries as described (McCafferty et al., 1990, Nature, 348:552-554; Clackson et al., 1991, Nature, 352: 624-628; and Marks et al., 1991, J. Mol. Biol., 222:581-597).

The polynucleotide encoding a monoclonal antibody can further be modified in a number of different manners using recombinant DNA technology to generate alternative antibodies. In one embodiment, the constant domains of the light and heavy chains of, for example, a mouse monoclonal antibody can be substituted: 1) for those regions of, for example, a human antibody to generate a chimeric antibody; or 2) for a non-immunoglobulin polypeptide to generate a fusion antibody. In other embodiments, the constant regions are truncated or removed to generate the desired antibody fragment of a monoclonal antibody. Furthermore, site-directed or high-density mutagenesis of the variable region can be used to optimize specificity, affinity, etc. of a monoclonal antibody.

For example, also contemplated are chimeric mouse-human monoclonal antibodies, which can be produced by recombinant DNA techniques known in the art. For example, a gene encoding the constant region of a murine (or other species) monoclonal antibody molecule is digested with restriction enzymes to remove the region encoding the murine constant region, and the equivalent portion of a gene encoding a human constant region is substituted (see, e.g., Robinson et al., PCT/US86/02269; European Patent Application 184,187; European Patent Application 171,496; European Patent Application 173,494; WO 86/01533; U.S. Pat. No. 4,816,567; European Patent Application 125,023 (each of which is herein incorporated by reference in its entirety); Better et al., Science, 240:1041-1043 (1988); Liu et al., Proc. Nat. Acad. Sci. USA, 84:3439-3443 (1987); Liu et al., J. Immunol., 139:3521-3526 (1987); Sun et al., Proc. Nat. Acad. Sci. USA, 84:214-218 (1987); Nishimura et al., Canc. Res., 47:999-1005 (1987); Wood et al., Nature, 314:446-449 (1985); and Shaw et al., J. Natl. Cancer Inst., 80:1553-1559 (1988)).

The chimeric antibody can be further humanized by replacing sequences of the variable region that are not directly involved in antigen binding with equivalent sequences from human variable regions. General reviews of humanized chimeric antibodies are provided by S. L. Morrison, Science 229: 1202-1207 (1985) and by Oi et al., Bio Techniques 4: 214 (1986). Those methods include isolating, manipulating, and expressing the nucleic acid sequences that encode all or part of immunoglobulin variable regions from at least one of a heavy or light chain. Sources of such nucleic acid are well known to those skilled in the art. The recombinant DNA encoding the chimeric antibody, or fragment thereof, can then be cloned into an appropriate expression vector.

Suitable humanized antibodies can alternatively be produced by CDR substitution (see, e.g., U.S. Pat. No. 5,225, 539; Jones et al., Nature, 321:552-525 (1986); Verhoeyan et al., Science, 239:1534 (1988); and Beidler et al., J. Immunol., 141:4053 (1988)). All of the CDRs of a particular human antibody may be replaced with at least a portion of a non-human CDR or only some of the CDRs may be replaced with non-human CDRs. It is only necessary to replace the number of CDRs important for binding of the humanized antibody to the Fc receptor.

An antibody can be humanized by any method that is capable of replacing at least a portion of a CDR of a human antibody with a CDR derived from a non-human antibody. The human CDRs may be replaced with non-human CDRs using oligonucleotide site-directed mutagenesis.

Also contemplated are chimeric and humanized antibodies in which specific amino acids have been substituted, deleted, or added. In particular, preferred humanized antibodies have amino acid substitutions in the framework region, such as to improve binding to the antigen. For example, in a humanized antibody having mouse CDRs, amino acids located in the human framework region can be replaced with the amino acids located at the corresponding positions in the mouse antibody. Such substitutions are known to improve binding of humanized antibodies to the antigen in some instances.

In certain embodiments provided herein, it is desirable to use an antibody fragment. Various techniques are known for the production of antibody fragments. Traditionally, these fragments are derived via proteolytic digestion of intact antibodies (for example Morimoto et al., 1993, Journal of Biochemical and Biophysical Methods 24:107-117 and Brennan et al., 1985, Science, 229:81). For example, papain digestion of antibodies produces two identical antigen-binding fragments, called Fab fragments, each with a single antigen-binding site, and a residual Fc fragment. Pepsin treatment yields an F(ab')2 fragment that has two antigen-combining sites and is still capable of cross-linking antigen.

However, these fragments are now typically produced directly by recombinant host cells as described above. Thus Fab, Fv, and scFv antibody fragments can all be expressed in and secreted from E. coli or other host cells, thus allowing the production of large amounts of these fragments. Alternatively, such antibody fragments can be isolated from the antibody phage libraries discussed above. The antibody fragment can also be linear antibodies as described in U.S. Pat. No. 5,641,870, for example, and can be monospecific or bispecific. Other techniques for the production of antibody fragments will be apparent to the skilled practitioner.

Fv is the minimum antibody fragment which contains a complete antigen-recognition and antigen-binding site. This region consists of a dimer of one heavy-chain and one light-chain variable domain in tight, non-covalent association. It is in this configuration that the three CDRs of each variable domain interact to define an antigen-binding site on the surface of the VH-VL dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The Fab fragment also contains the constant domain of the light chain and the first constant domain (CH1) of the heavy chain. Fab fragments differ from Fab' fragments by the addition of a few residues at the carboxy terminus of the heavy chain CH1 domain including one or more cysteines from the antibody hinge region. F(ab')2 antibody fragments originally were produced as pairs of Fab' fragments which have hinge cysteines between them. Other chemical couplings of antibody fragments are also known to the skilled artisan.

The technology herein provided also contemplates modifying an antibody to increase its serum half-life. This can be achieved, for example, by incorporating a salvage receptor binding epitope into the antibody fragment by mutation of the appropriate region in the antibody fragment or by incorporating the epitope into a peptide tag that is then fused to the antibody fragment at either end or in the middle (e.g., by DNA or peptide synthesis).

The technology embraces variants and equivalents which are substantially homologous to the chimeric, humanized, and human antibodies, or antibody fragments thereof, provided herein. These can contain, for example, conservative substitution mutations, e.g., the substitution of one or more amino acids by similar amino acids. For example, conservative substitution refers to the substitution of an amino acid with another within the same general class such as, for example, one acidic amino acid with another acidic amino acid, one basic amino acid with another basic amino acid, or one neutral amino acid by another neutral amino acid. What is intended by a conservative amino acid substitution is well known in the art.

An additional embodiment utilizes the techniques known in the art for the construction of Fab expression libraries (Huse et al., Science, 246:1275-1281 (1989)) to allow rapid and easy identification of monoclonal Fab fragments with the desired specificity.

Also, this technology encompasses bispecific antibodies that specifically recognize Dscam or a biological component associated with the functions and/or dysfunctions of Dscam (e.g., a biological component that can be modulated to counteract aberrant Dscam expression and/or activity, e.g., Abl kinase). Bispecific antibodies are antibodies that are capable of specifically recognizing and binding at least two different epitopes. Bispecific antibodies can be intact antibodies or antibody fragments. Techniques for making bispecific antibodies are common in the art (Millstein et al., 1983, Nature 305:537-539; Brennan et al., 1985, Science 229:81; Suresh et al, 1986, Methods in Enzymol. 121:120; Traunecker et al., 1991, EMBO J. 10:3655-3659; Shalaby et al., 1992, J. Exp. Med. 175:217-225; Kostelny et al., 1992, J. Immunol. 148:1547-1553; Gruber et al., 1994, J. Immunol. 152:5368; and U.S. Pat. No. 5,731,168).

Techniques described for the production of single chain antibodies (U.S. Pat. No. 4,946,778; herein incorporated by reference) can be adapted to produce specific single chain antibodies as desired. Single-chain Fv antibody fragments comprise the VH and VL domains of an antibody, wherein these domains are present in a single polypeptide chain. Preferably, the Fv polypeptide further comprises a polypeptide linker between the VH and VL domains that enables the single-chain Fv antibody fragments to form the desired structure for antigen binding. For a review of single-chain Fv antibody fragments, see Pluckthun in The Pharmacology of Monoclonal Antibodies, vol. 113, Rosenburg and Moore eds., Springer-Verlag, New York, pp. 269-315 (1994).

RNA-Induced Gene Silencing

It is also contemplated that modulating the activity of Dscam or a biological component associated with the functions and/or dysfunctions of Dscam (e.g., a biological component that can be modulated to counteract aberrant Dscam expression and/or activity, e.g., Abl kinase) can be accomplished by, for example, RNA-induced gene silencing. RNA-induced gene silencing can occur by at least three different modes: 1) transcription inactivation, which refers to RNA-guided DNA or histone methylation; 2) siRNA-induced mRNA degradation; and 3) mRNA-induced transcriptional attenuation. Accordingly, in some embodiments, an siRNA inactivates, targets, and/or degrades mRNA encoding Dscam or a biological component associated with the functions and/or dysfunctions of Dscam (e.g., a biological component that can be modulated to counteract aberrant Dscam expression and/or activity, e.g., Abl kinase). In some embodiments, an siRNA attenuates translation of an mRNA encoding Dscam or of a biological component associated with the functions and/or dysfunctions of Dscam (e.g., a biological component that can be modulated to counteract aberrant Dscam expression and/or activity, e.g., Abl kinase).

Some embodiments comprise use of short (18 to 30 nt or bp, e.g., 20 to 25 nt or bp) RNA duplexes (dsRNA), e.g., to effect a sequence-specific inhibition of a target mRNA and/or its translation product. Certain short dsRNAs, referred to as small inhibitory RNAs ("siRNAs"), act catalytically at sub-molar concentrations to cleave greater than 95% of the target mRNA in the cell. While not limited in their features, typically an siRNA is 21 nucleotides long and has a 2-nt 3' overhang on each end. Each strand has a 5' phosphate group and a 3' hydroxyl group.

In vivo, this structure results from processing by dicer, a Type III endonuclease enzyme (e.g., a ribonuclease-III-like enzyme) that converts either long dsRNAs or small hairpin RNAs (shRNA) into siRNAs. After introduction of a long double stranded RNA into plants and invertebrate cells, it is processed to produce an siRNA by Dicer (see, e.g., Sharp (2001) "RNA interference—2001" *Genes Dev* 15: 485). In particular, dicer processes the dsRNA into 19 to 23 bp siRNAs with characteristic two-base 3' overhangs (see, e.g., Bernstein et al. (2001) "Role for a bidentate ribonuclease in the initiation step of RNA interference" *Nature* 409: 363). The siRNAs are then incorporated into an RNA-induced silencing complex (RISC) where one or more helicases unwind the siRNA duplex, enabling the complementary antisense strand to guide target recognition (see, e.g., Nykanen et al. (2001) "ATP requirements and small interfering RNA structure in the RNA interference pathway" *Cell* 107: 309). Upon binding to the appropriate target mRNA, one or more endonucleases within the RISC cleaves the target to induce silencing (see, e.g., Elbashir et al. (2001) "RNA interference is mediated by 21- and 22-nucleotide RNAs" *Genes Dev* 15: 188).

However, siRNAs can also be synthesized and exogenously introduced into cells to bring about the specific knockdown of a gene of interest. Consequently, essentially any gene of which the sequence is known (wholly or partially) can be targeted based on sequence complementarity with an appropriately tailored siRNA. For example, those of ordinary skill in the art can synthesize an siRNA (see, e.g., Elbashir et al. (2001) *Nature* 411: 494; Elbashir et al. (2001) *Genes Dev* 15: 188; Tuschl et al. (1999) *Genes Dev* 13: 3191).

Furthermore, the interference effect can be long lasting and may be detectable after many cell divisions. In addition, RNA induced attenuation of gene expression exhibits sequence specificity (Kisielow et al. (2002) "Isoform-specific knockdown and expression of adaptor protein ShcA using small interfering RNA" *J. Biochem.* 363: 1-5) and the cell machinery involved in the process can specifically knock down one type of transcript, while not affecting closely related mRNA. Thus, siRNA in some embodiments inhibits gene expression, e.g., for studying gene function and as therapeutic agents against: diseases that are caused by over-expression and/or misexpression of genes and/or diseases brought about by expression of genes that contain mutations.

A description of the mechanisms for siRNA activity, as well as some of its applications are described in Provost et al. (2002) "Ribonuclease Activity and RNA Binding of Recombinant Human Dicer" *EMBO J.* 21(21): 5864-5874; Tabara et al. (2002) "The dsRNA Binding Protein RDE-4 Interacts with RDE-1, DCR-1 and a DexH-box Helicase to Direct RNAi in *C. elegans*" *Cell* 109(7): 861-71; Ketting et al. (2002) "Dicer Functions in RNA Interference and in Synthesis of Small RNA Involved in Developmental Timing in *C. elegans*"; Martinez et al "Single-Stranded Antisense siRNAs Guide Target RNA Cleavage in RNAi" *Cell* 110(5): 563; Hutvagner & Zamore (2002) "A microRNA in a multiple-turnover RNAi enzyme complex" *Science* 297: 2056.

Accordingly, embodiments provide for the RNA-induced gene silencing of Dscam or a biological component associated with the functions and/or dysfunctions of Dscam (e.g., a biological component that can be modulated to counteract aberrant Dscam expression and/or activity, e.g., Abl kinase), e.g., to modulate the activity of Dscam or a biological component associated with the functions and/or dysfunctions of Dscam (e.g., a biological component that can be modulated to counteract aberrant Dscam expression and/or activity, e.g., Abl kinase).

For example, embodiments provide for the uses of a dsRNA and/or siRNA designed to target a sequence provided by SEQ ID NO: 1 and/or a sequence provided by SEQ ID NO: 2. In some embodiments, a dsRNA and/or siRNA is designed to target a sequence referenced by the accession numbers in Table 1. In some embodiments, a dsRNA and/or siRNA is designed to target a sequence of the human ABL1 gene or a transcription product thereof, e.g., an mRNA having a sequence provided by NCBI accession number NM_005157.4 (isoform a) or NM_007313.2 (isoform b). In some embodiments, a dsRNA and/or siRNA is designed to target a sequence referenced by the accession numbers in Table 2. The technology also contemplates dsRNA and siRNA against mutants (e.g., substitutions, deletions, insertions, or other changes), substituted variants, domain-swapped variants, circularly permuted variants, homologs (e.g., orthologs, paralogs), truncated forms, codon-optimized forms, fusions, etc. of these nucleotide sequences. In addition, the technology contemplates nucleic acids for dsRNA and/or siRNA that are not completely complementary to their targets. Such designs are known in the art, e.g., to provide control over the extent of gene silencing provided by a dsRNA and/or siRNA against its target.

One exemplary endogenous RNA involved in regulating the Dscam pathway is miRNA-203 (see, e.g., Bueno et al. (2008). "Genetic and epigenetic silencing of microRNA-203 enhances ABL1 and BCR-ABL1 oncogene expression" *Cancer Cell* 13 (6): 496-506.

In some embodiments, Abl kinase expression and/or activity is modulated by a CRISPR/Cas9 genome editing technology. Using this technology, a Cas9 protein is guided to a specific location within a genome (e.g., to an Abl gene) by a short RNA. Using this system, DNA sequences within a genome and their expression products (e.g., mRNA transcripts and polypeptide translation products) are edited or modulated in any organism of choice. See, e.g., U.S. Pat. No. 8,697,359 and Hsu et al (2014) "Development and Applications of CRISPR-Cas9 for Genome Engineering" *Cell* 157: 1262, each incorporated herein by reference in its entirety for all purposes.

Pharmaceutical Formulations

It is generally contemplated that the compositions related to the technology are formulated for administration to a mammal, and especially to a human with a condition that is responsive to the administration of such compounds. Therefore, where contemplated compounds are administered in a pharmacological composition, it is contemplated that the contemplated compounds are formulated in admixture with a pharmaceutically acceptable carrier. For example, contemplated compounds can be administered orally as pharmacologically acceptable salts (e.g., in the form of a hydrochloride monohydrate salt), or intravenously in a physiological saline solution (e.g., buffered to a pH of about 7.2 to 7.5). Conventional buffers such as phosphates, bicarbonates, or citrates can be used for this purpose. Of course, one of ordinary skill in the art may modify the formulations within the teachings of the specification to provide numerous formulations for a particular route of administration. In particular, contemplated compounds may be modified to render them more soluble in water or other vehicle, which for example, may be easily accomplished with minor modifications (salt formulation, esterification, etc.) that are well within the ordinary skill in the art. It is also well within the ordinary skill of the art to modify the route of administration and dosage regimen of a particular compound to manage the pharmacokinetics of the present compounds for maximum beneficial effect in a patient.

In certain pharmaceutical dosage forms, prodrug forms of contemplated compounds may be formed for various purposes, including reduction of toxicity, increasing the organ or target cell specificity, etc. Among various prodrug forms, acylated (acetylated or other) derivatives, pyridine esters, and various salt forms of the present compounds are preferred (e.g., a hydrochloride monohydrate salt). One of ordinary skill in the art will recognize how to modify the present compounds to prodrug forms to facilitate delivery of active compounds to a target site within the host organism or patient. One of ordinary skill in the art will also take advantage of favorable pharmacokinetic parameters of the prodrug forms, where applicable, in delivering the present compounds to a targeted site within the host organism or patient to maximize the intended effect of the compound. Similarly, it should be appreciated that contemplated compounds may also be metabolized to their biologically active form, and all metabolites of the compounds herein are therefore specifically contemplated. In addition, contemplated compounds (and combinations thereof) may be administered in combination with yet further agents.

With respect to administration to a subject, it is contemplated that the compounds be administered in a pharmaceutically effective amount. One of ordinary skill recognizes that a pharmaceutically effective amount varies depending on the therapeutic agent used, the subject's age, condition, and sex, and on the extent of the disease in the subject. Generally, the dosage should not be so large as to cause adverse side effects, such as hyperviscosity syndromes, pulmonary edema, congestive heart failure, and the like. The dosage can also be adjusted by the individual physician or veterinarian to achieve the desired therapeutic goal.

As used herein, the actual amount encompassed by the term "pharmaceutically effective amount" will depend on the route of administration, the type of subject being treated, and the physical characteristics of the specific subject under consideration. These factors and their relationship to determining this amount are well known to skilled practitioners in the medical, veterinary, and other related arts. This amount and the method of administration can be tailored to maximize efficacy but will depend on such factors as weight, diet, concurrent medication, and other factors that those skilled in the art will recognize.

Pharmaceutical compositions preferably comprise one or more compounds of the present technology associated with one or more pharmaceutically acceptable carriers, diluents, or excipients. Pharmaceutically acceptable carriers are known in the art such as those described in, for example, Remingtons Pharmaceutical Sciences, Mack Publishing Co. (A. R. Gennaro edit. 1985), explicitly incorporated herein by reference for all purposes.

Accordingly, in some embodiments, the immunotherapeutic agent is formulated as a tablet, a capsule, a time release tablet, a time release capsule; a time release pellet; a slow release tablet, a slow release capsule; a slow release pellet; a fast release tablet, a fast release capsule; a fast release pellet; a sublingual tablet; a gel capsule; a microencapsulation; a transdermal delivery formulation; a transdermal gel; a transdermal patch; a sterile solution; a sterile solution prepared for use as an intramuscular or subcutaneous injection, for use as a direct injection into a targeted site, or for intravenous administration; a solution prepared for rectal administration; a solution prepared for administration through a gastric feeding tube or duodenal feeding tube; a suppository for rectal administration; a liquid for oral consumption prepared as a solution or an elixir; a topical cream; a gel; a lotion; a tincture; a syrup; an emulsion; or a suspension.

In some embodiments, the time release formulation is a sustained-release, sustained-action, extended-release, controlled-release, modified release, or continuous-release mechanism, e.g., the composition is formulated to dissolve quickly, slowly, or at any appropriate rate of release of the compound over time.

In some embodiments, the compositions are formulated so that the active ingredient is embedded in a matrix of an insoluble substance (e.g., various acrylics, chitin) such that the dissolving compound finds its way out through the holes in the matrix, e.g., by diffusion. In some embodiments, the formulation is enclosed in a polymer-based tablet with a laser-drilled hole on one side and a porous membrane on the other side. Stomach acids push through the porous membrane, thereby pushing the drug out through the laser-drilled hole. In time, the entire drug dose releases into the system while the polymer container remains intact, to be excreted later through normal digestion. In some sustained-release formulations, the compound dissolves into the matrix and the matrix physically swells to form a gel, allowing the compound to exit through the gel's outer surface. In some embodiments, the formulations are in a micro-encapsulated form, e.g., which is used in some embodiments to produce a complex dissolution profile. For example, by coating the compound around an inert core and layering it with insoluble substances to form a microsphere, some embodiments provide more consistent and replicable dissolution rates in a convenient format that is combined in particular embodiments with other controlled (e.g., instant) release pharmaceutical ingredients, e.g., to provide a multipart gel capsule.

In some embodiments, the pharmaceutical preparations and/or formulations of the technology are provided in particles. "Particles" as used herein refers to nanoparticles or microparticles (or, in some instances, larger particles) that can consist in whole or in part of the compounds as described herein. The particles may contain the preparations and/or formulations in a core surrounded by a coating, including, but not limited to, an enteric coating. The preparations and/or formulations also may be dispersed throughout the particles. The preparations and/or formulations also may be absorbed into the particles or adsorbed onto the particles. The particles may be of any order release kinetics, including zero order release, first order release, second order release, delayed release, sustained release, immediate release, and any combination thereof, etc. The particle may include, in addition to the preparations and/or formulations, any of those materials routinely used in the art of pharmacy and medicine, including, but not limited to, erodible, nonerodible, biodegradable, or nonbiodegradable materials or combinations thereof. The particles may be microcapsules which contain the formulation in a solution or in a semi-solid state. The particles may be of virtually any shape.

Both non-biodegradable and biodegradable polymeric materials can be used in the manufacture of particles for delivering the preparations and/or formulations. Such polymers may be natural or synthetic polymers. The polymer is selected based on the period of time over which release is desired. Bioadhesive polymers of particular interest include bioerodible hydrogels described by H. S. Sawhney, C. P. Pathak and J. A. Hubell in Macromolecules, (1993) 26: 581-587, the teachings of which are incorporated herein by reference. These include polyhyaluronic acids, casein, gelatin, glutin, polyanhydrides, polyacrylic acid, alginate, chitosan, poly(methyl methacrylates), poly(ethyl methacrylates), poly(butylmethacrylate), poly (isobutyl methacrylate), poly(hexylmethacrylate), poly(isodecyl methacrylate), poly(lauryl methacrylate), poly(phenylmethacrylate), poly(methyl acrylate), poly(isopropyl acrylate), poly(isobutyl acrylate), and poly(octadecyl acrylate).

The technology also provides methods for preparing stable pharmaceutical preparations containing aqueous solutions of the compounds or salts thereof to inhibit formation of degradation products. A solution is provided that contains the compound or salts thereof and at least one inhibiting agent. The solution is processed under at least one sterilization technique prior to and/or after terminal filling the solution in the sealable container to form a stable pharmaceutical preparation. The present formulations may be prepared by various methods known in the art so long as the formulation is substantially homogenous, e.g., the pharmaceutical is distributed substantially uniformly within the formulation. Such uniform distribution facilitates control over drug release from the formulation.

In some embodiments, the compound is formulated with a buffering agent. The buffering agent may be any pharmaceutically acceptable buffering agent. Buffer systems include citrate buffers, acetate buffers, borate buffers, and phosphate buffers. Examples of buffers include citric acid, sodium citrate, sodium acetate, acetic acid, sodium phosphate and phosphoric acid, sodium ascorbate, tartartic acid, maleic acid, glycine, sodium lactate, lactic acid, ascorbic acid, imidazole, sodium bicarbonate and carbonic acid, sodium succinate and succinic acid, histidine, and sodium benzoate and benzoic acid.

In some embodiments, the compound is formulated with a chelating agent. The chelating agent may be any pharmaceutically acceptable chelating agent. Chelating agents include ethylenediaminetetraacetic acid (also synonymous with EDTA, edetic acid, versene acid, and sequestrene), and EDTA derivatives, such as dipotassium edetate, disodium edetate, edetate calcium disodium, sodium edetate, trisodium edetate, and potassium edetate. Other chelating agents include citric acid and derivatives thereof. Citric acid also is known as citric acid monohydrate. Derivatives of citric acid include anhydrous citric acid and trisodiumcitrate-dihydrate. Still other chelating agents include niacinamide and derivatives thereof and sodium desoxycholate and derivatives thereof.

In some embodiments, the compound is formulated with an antioxidant. The antioxidant may be any pharmaceutically acceptable antioxidant. Antioxidants are well known to those of ordinary skill in the art and include materials such as ascorbic acid, ascorbic acid derivatives (e.g., ascorbylpalmitate, ascorbylstearate, sodium ascorbate, calcium ascorbate, etc.), butylated hydroxy anisole, butylated hydroxy toluene, alkylgallate, sodium meta-bisulfate, sodium bisulfate, sodium dithionite, sodium thioglycollic acid, sodium formaldehyde sulfoxylate, tocopherol and derivatives thereof, (d-alpha tocopherol, d-alpha tocopherol acetate, dl-alpha tocopherol acetate, d-alpha tocopherol succinate, beta tocopherol, delta tocopherol, gamma tocopherol, and d-alpha tocopherol polyoxyethylene glycol 1000 succinate) monothioglycerol, and sodium sulfite. Such materials are typically added in ranges from 0.01 to 2.0%.

In some embodiments, the compound is formulated with a cryoprotectant. The cryoprotecting agent may be any pharmaceutically acceptable cryoprotecting agent. Common cryoprotecting agents include histidine, polyethylene glycol, polyvinyl pyrrolidine, lactose, sucrose, mannitol, and polyols.

In some embodiments, the compound is formulated with an isotonicity agent. The isotonicity agent can be any pharmaceutically acceptable isotonicity agent. This term is used in the art interchangeably with iso-osmotic agent, and is known as a compound which is added to the pharmaceutical preparation to increase the osmotic pressure, e.g., in some embodiments to that of 0.9% sodium chloride solution, which is iso-osmotic with human extracellular fluids, such as plasma. Preferred isotonicity agents are sodium chloride, mannitol, sorbitol, lactose, dextrose and glycerol.

The pharmaceutical preparation may optionally comprise a preservative. Common preservatives include those selected from the group consisting of chlorobutanol, parabens, thimerosol, benzyl alcohol, and phenol. Suitable preservatives include but are not limited to: chlorobutanol (0.3-0.9% w/v), parabens (0.01-5.0%), thimerosal (0.004-0.2%), benzyl alcohol (0.5-5%), phenol (0.1-1.0%), and the like.

In some embodiments, the compound is formulated with a humectant to provide a pleasant mouth-feel in oral applications. Humectants known in the art include cholesterol, fatty acids, glycerin, lauric acid, magnesium stearate, pentaerythritol, and propylene glycol.

In some embodiments, an emulsifying agent is included in the formulations, for example, to ensure complete dissolution of all excipients, especially hydrophobic components such as benzyl alcohol. Many emulsifiers are known in the art, e.g., polysorbate 60.

For some embodiments related to oral administration, it may be desirable to add a pharmaceutically acceptable flavoring agent and/or sweetener. Compounds such as saccharin, glycerin, simple syrup, and sorbitol are useful as sweeteners.

Cell-Targeting Moieties

In some embodiments, compounds according to the technology comprise a cell-targeting moiety. In some embodiments, the cell-targeting moiety comprises an antibody, or derivative or fragment thereof. Antibodies to cell-specific molecules such as, e.g., proteins (e.g., cell-surface proteins, membrane proteins, proteoglycans, glycoproteins, peptides, and the like); polynucleotides (nucleic acids, nucleotides); lipids (e.g., phospholipids, glycolipids, and the like), or fragments thereof comprising an epitope or antigen specifically recognized by the antibody, target compounds according to the technology to the cells expressing the cell-specific molecules.

Antibodies that target normal tissues or organs are disclosed in, e.g., U.S. Pat. No. 4,735,210. In another embodiment, the antibody may be targeted to a predetermined target associated with an undesirable target. The particular target and antibody may be specific to, but not limited to, the type of the undesirable target. An undesirable target is a target that may be associated with a disease or an undesirable condition, but that also may present in the normal condition (e.g., an Abl tyrosine kinase). For example, the target may be present at elevated concentrations or otherwise be altered in the disease or undesirable state. Antibody may have an affinity for the undesirable target or for biological molecular pathways related to the undesirable target. Antibody may have an affinity for a cell marker or markers associated with the undesirable target. For an undesirable target, the choice of a predetermined target may be important to therapy utilizing the compounds according to the present technology (e.g., the drug and/or therapeutic moieties). The antibody may be selected to target biological matter associated with a disease or undesirable condition. In another embodiment, the antibody may be targeted to a predetermined target associated with non-cancerous diseased tissue. The particular target and antibody may be specific to, but not limited to, a particular non-cancerous diseased tissue, such as non-cancerous diseased deposits and precursor deposits. The antibody may have an affinity for a biological molecule associated with the non-cancerous diseased tissue. The antibody may have an affinity for a cell marker or markers associated with the non-cancerous diseased tissue.

In some embodiments, the antibody directs a composition to a biological location (e.g., a tissue, organ, cell, etc.) in need of treatment with a kinase inhibitor to ameliorate a neurological malady. For example, in some embodiments, the antibody directs an Abl kinase inhibitor to a nerve cell (e.g., a neuron).

See, e.g., U.S. Pat. Appl. Pub. No. 2005/0090732, incorporated herein by reference (in particular Table I) for a list of targets, cell-specific markers (e.g., antigens for targeting with an antibody moiety), antibodies, and indications associated with those targets, cell-specific markers, and antigens/antibodies.

Methods

Some embodiments of the technology relate to methods of treating a subject having a neurological malady and/or diagnosing and treating a subject having a neurological malady.

Subjects

In some embodiments, the technology is related to administering a composition to a subject in need of a treatment for a neurological disorder. In some embodiments, the subject has a neurological malady associated with aberrant axonal growth. In some embodiments, the subject has Down syndrome. In some embodiments, the subject has epilepsy, bipolar disorder, fragile X mental retardation, or autism spectrum disorder.

In some embodiments, the subject is in need of treatment for a neurological disorder and does not have cancer (e.g., a leukemia, e.g., CML); in some embodiments, the subject is in need of treatment for a neurological disorder and has cancer. In some embodiments, the subject is in need of treatment for a neurological disorder and has not been treated for cancer (e.g., a leukemia, e.g., CML) nor is being treated for cancer (e.g., a leukemia, e.g., CML); in some embodiments, the subject is in need of treatment for a neurological disorder and is being treated and/or has been treated for cancer.

In some embodiments, the subject is in need of treatment for a neurological disorder and does not have Alzheimer's disease; in some embodiments, the subject is in need of treatment for a neurological disorder and has Alzheimer's disease. In some embodiments, the subject is in need of treatment for a neurological disorder and has not been treated for Alzheimer's disease nor is being treated for Alzheimer's disease; in some embodiments, the subject is in need of treatment for a neurological disorder and is being treated and/or has been treated for Alzheimer's disease.

In some embodiments, the subject is in need of treatment for a neurological disorder and does not have Parkinson's disease; in some embodiments, the subject is in need of treatment for a neurological disorder and has Parkinson's disease. In some embodiments, the subject is in need of treatment for a neurological disorder and has not been treated for Parkinson's disease nor is being treated for Parkinson's disease; in some embodiments, the subject is in need of treatment for a neurological disorder and is being treated and/or has been treated for Parkinson's disease.

In some embodiments, the subject has aberrant and/or dysregulated expression and/or activity of Dscam. In some embodiments, the subject has an increased expression and/or increased activity of Dscam. In some embodiments, the increase is 10%, 20%, 30%, 40%, 50%, 60%, 70%, 80%, 90%, 100%, 150%, 200%, 250%, 500%, or 1000% or more of the expression and/or activity of Dscam in a normal subject (e.g., one who does not have a neurological disorder and/or who has a Dscam activity and/or expression that is the same, essentially the same, and/or substantially the same as a mean and/or median activity and/or expression of the population and/or of a normal control group).

In some embodiments, the subject has an abnormal number of DSCAM genes, e.g., as a result of an aneuploidy (e.g., a trisomy, e.g., a trisomy 21), gene amplification, etc. In some embodiments, the subject has aberrant regulation of transcription of a Dscam gene (e.g., as a result of aberrant epigenomic regulation, e.g., as a result of disrupted methylation, as a result of aberrant chromosome structure (e.g., aberrant histone binding and/or aberrant access to the gene), as a result of a genetic rearrangement (e.g., insertion, deletion, fusion, mutation) that increases transcription, as a result of aberrant upstream activation of Dscam by impinging pathways, as a result of aberrant upstream repression of Dscam by impinging pathways, as a result of aberrant cis-acting regulatory sequences (e.g., transcriptional regulatory sequences, enhancers, promoters, binding sites for transcriptional activation, etc), as a result of increased activity of a substituted Dscam protein, as a result of increased stability of a substituted Dscam protein, etc. Such aberrations are detectable using techniques known in the art, e.g., such as those described herein.

In some embodiments, the subject is a human, e.g., a member of *Homo sapiens*. In some embodiments, the subject has an abnormal number of copies of the DSCAM gene, e.g., a nucleic acid sequence (or a complement thereof) comprising, consisting of, or consisting essentially of a sequence provided by accession number NC_000021.8. In some embodiments, the subject has an aberrant and/or dysregulated (e.g., increased) amount of a product of the DSCAM gene, e.g., a mRNA comprising, consisting of, or consisting essentially of a sequence (or a complement thereof) provided by accession number NM_001389.3 and/or a protein comprising, consisting of, or consisting essentially of a sequence provided by accession number NP_001380.2 and/or a protein comprising, consisting of, or consisting essentially of a sequence that is a translation product of a sequence (or a complement thereof) provided by accession number NC_000021.8 and/or NM_001389.3.

In some embodiments, the subject has an abnormal number of copies of the ABL1 gene, e.g., a nucleic acid sequence (or a complement thereof) comprising, consisting of, or consisting essentially of a sequence provided by accession number NG_012034.1 or a sequence provided by NC_000009.11. In some embodiments, the subject has an aberrant and/or dysregulated (e.g., increased) amount of a product of the ABL1 gene, e.g., a mRNA comprising, consisting of, or consisting essentially of a sequence (or a complement thereof) provided by accession number NM_005157.4 and/or NM_007313.2; and/or a protein comprising, consisting of, or consisting essentially of a sequence provided by accession number NP_005148.2 and/or NP_009297.2; and/or a protein comprising, consisting of, or consisting essentially of a sequence that is a translation product of a sequence (or a complement thereof) provided by accession number NG_012034.1, NC_000009.11, NM_005157.4, and/or NM_007313.2.

In some embodiments, the subject has a chromosomal aberration. In some embodiments, the subject is anueploid. In some embodiments, the subject has a trisomy. In some embodiments, the subject has a trisomy of chromosome 21.

In some embodiments, the subject is in need of treatment with an agent that modulates (e.g., decreases) the activity of a kinase (e.g., a tyrosine kinase), e.g., Abl kinase. In some embodiments, the subject is in need of treatment with an agent that modulates a biological component associated with the functions and/or dysfunctions of Dscam (e.g., a biological component that can be modulated to counteract aberrant Dscam expression and/or activity, e.g., Abl kinase). In some embodiments, the subject is in need of treatment with an agent that modulates (e.g., decreases) the activity of a biological component of a pathway downstream of Dscam. In some embodiments, the subject is in need of treatment with an agent that modulates (e.g., increases) the activity of a biological component of a pathway downstream of Dscam. In some embodiments, the subject is in need of treatment with an agent that modulates (e.g., increases) the activity of a biological component of a pathway upstream of Dscam. In some embodiments, the subject is in need of treatment with an agent that modulates (e.g., decreases) the activity of a biological component of a pathway upstream of Dscam. In some embodiments, the subject is in need of treatment with an agent that modulates the temporal and/or spatial expression and/or activity of Dscam and/or a biological component of a pathway upstream of Dscam and/or a biological component of a pathway downstream of Dscam.

In some embodiments, a chromosomal abnormality in a fetus is assessed, e.g., by amniocentesis, chorionic villi sampling, and/or by analyzing circulating free fetal DNA in a blood sample taken from a pregnant mother. The results of such tests can be used for medical intervention prior to or after birth.

In some embodiments, the subject is a child (e.g., having an age of from birth to 18 years old, e.g., having an age of 1, 10, 15, 20, 30, or 45 minutes; 1, 2, 3, 4, 6, or 12 hours; 1, 2, 3, 4, 5, or 6 days; 1, 2, or 3 weeks; 1, 2, 3, 4, 5, 6, 7, 8, 9, 10, or 11 months; 1, 2, 3, 4, 5, 6, 7, 8, 9, 10, 11, 12, 13, 14, 15, 16, 17, or 18 years; or, in some embodiments, pre-natal, e.g., a fetus or other pre-natal stage of development). Accordingly, in some embodiments, the subject is a fetus prior to birth and the fetus is treated by administering a therapy to a pregnant mother.

Administration, Treatments, and Dosing

In some embodiments, the technology relates to methods of providing (e.g., administering) a dosage of a compound to a subject. The methods comprise one or more of the general steps of administering a compound according to the technology, measuring a level of a biological molecule (e.g., biomarker) in a sample obtained from the subject, and, in some embodiments, adjusting the dose based on the measured level of the detectable label. For example, in some embodiments, the methods comprise measuring the expression and/or activity of a Dscam and/or of a biological component associated with the functions and/or dysfunctions of Dscam (e.g., a biological component that can be modulated to counteract aberrant Dscam expression and/or activity, e.g., Abl kinase) and administering an agent that modulates (e.g., decreases, increases) the activity of the biological component associated with the functions and/or dysfunctions of Dscam (e.g., the biological component that can be modulated to counteract aberrant Dscam expression and/or activity, e.g., Abl kinase). In some embodiments, the agent does not affect Dscam expression and/or activity. In some embodiments, the subject is not tested for a level, e.g., of Dscam and/or Abl kinase, but has symptoms associated with a neurological disorder such as Down syndrome, epilepsy, bipolar disorder, or fragile X mental retardation.

In some embodiments, a compound, a derivative thereof, or a pharmaceutically acceptable salt thereof (e.g., a hydrochloride monohydrate salt), is administered in a pharmaceutically effective amount. In some embodiments, a compound, a derivative thereof, or a pharmaceutically acceptable salt thereof, is administered in a therapeutically effective dose.

The dosage amount and frequency are selected to create an effective level of the compound without substantially harmful effects. When administered orally or intravenously, the dosage of the compound or related compounds will generally range from 0.001 to 10,000 mg/kg/day or dose (e.g., 0.01 to 1000 mg/kg/day or dose; 0.1 to 100 mg/kg/day or dose).

Methods of administering a pharmaceutically effective amount include, without limitation, administration in parenteral, oral, intraperitoneal, intranasal, topical, sublingual, rectal, and vaginal forms. Parenteral routes of administration include, for example, subcutaneous, intravenous, intramuscular, intrasternal injection, and infusion routes. In some embodiments, the compound, a derivative thereof, or a pharmaceutically acceptable salt thereof, is administered orally.

In some embodiments, the compound is nilotinib provided at approximately 600 mg per day in one or more doses, e.g., to a human.

In some embodiments, a single dose of a compound or a related compound is administered to a subject. In other embodiments, multiple doses are administered over two or more time points, separated by hours, days, weeks, etc. In some embodiments, compounds are administered over a long period of time (e.g., chronically), for example, for a period of months or years (e.g., 1, 2, 3, 4, 5, 6, 7, 8, 9, 10, 11, 12, or more months or years). In such embodiments, compounds may be taken on a regular scheduled basis (e.g., daily, weekly, etc.) for the duration of the extended period.

The technology also relates to methods of treating a subject with a drug appropriate for the subject's malady. According to another aspect of the technology, a method is provided for treating a subject in need of such treatment with an effective amount of a compound or a salt thereof. The method involves administering to the subject an effective amount of a compound or a salt thereof in any one of the pharmaceutical preparations described above, detailed herein, and/or set forth in the claims. The subject can be any subject in need of such treatment. In the foregoing description, the technology is in connection with a compound or salts thereof. Such salts include, but are not limited to, bromide salts, chloride salts, iodide salts, carbonate salts, and sulfate salts. It should be understood, however, that the compound is a member of a class of compounds and the technology is intended to embrace pharmaceutical preparations, methods, and kits containing related derivatives within this class. Another aspect of the technology then embraces the foregoing summary but read in each aspect as if any such derivative is substituted wherever "compound" appears.

In some embodiments, a subject is tested to assess the presence, the absence, or the level of a malady and/or a condition. Such testing is performed, e.g., by assaying or measuring a detectable agent, e.g., a biomarker, a metabolite, a physical symptom, an indication, etc., to determine the risk of or the presence of the malady or condition. For example, in some embodiments, the expression or activity of Dscam is measured and in some embodiments the expression or activity of a biological component associated with the functions and/or dysfunctions of Dscam (e.g., a biological component that can be modulated to counteract aberrant Dscam expression and/or activity, e.g., Abl kinase).

In some embodiments, the subject is treated with a compound based on the outcome of the test. In some embodiments, a subject is treated, a sample is obtained and the level of detectable agent is measured, and then the subject is treated again based on the level of detectable agent that was measured. In some embodiments, a subject is treated, a sample is obtained and the level of detectable agent is measured, the subject is treated again based on the level of detectable agent that was measured, and then another sample is obtained and the level of detectable agent is measured. In some embodiments, other tests (e.g., not based on measuring the level of detectable agent) are also used at various stages, e.g., before the initial treatment as a guide for the initial dose. In some embodiments, a subsequent treatment is adjusted based on a test result, e.g., the dosage amount, dosage schedule, identity of the drug, etc. is changed. In some embodiments, a patient is tested, treated, and then tested again to monitor the response to therapy and/or change the therapy. In some embodiments, cycles of testing and treatment may occur without limitation to the pattern of testing and treating, the periodicity, or the duration of the interval between each testing and treatment phase. As such, the technology contemplates various combinations of testing and treating without limitation, e.g., test/treat, treat/test, test/treat/test, treat/test/treat, test/treat/test/treat, test/treat/treat/test, test/treat/test/test/treat/treat/treat/test, treat/treat/test/treat, test/treat/treat/test/treat/treat, etc.

Detection

In some embodiments, the technology relates to detecting aberrant and/or dysregulated expression of a biological molecule, e.g., a Dscam (e.g., at the chromosomal (e.g., gene) level, mRNA, and/or protein stage). Aberrant and/or dysregulated expression of a biological molecule, e.g., a Dscam, is detectable as a chromosomal rearrangement, e.g., an aneuploidy or rearrangement resulting in the aberrant and/or dysregulated expression of the biological molecule. Once transcribed, aberrant and/or dysregulated expression of a biological molecule, e.g., a Dscam, is detectable by measuring levels of the mRNA encoding the biological molecule, e.g., a Dscam. Once translated, aberrant and/or dysregulated expression of a biological molecule, e.g., a Dscam, is detectable by measuring levels of the protein translated from the mRNA.

In some embodiments, a chromosomal aberration (e.g., an aneuploidy such as trisomy 21) is detected using, e.g., in situ hybridization methods, e.g., fluorescence in situ hybridization (FISH), using a suitable oligonucleotide probe (e.g., a labeled oligonucleotide probe). Illustrative non-limiting examples of nucleic acid hybridization techniques include, but are not limited to, in situ hybridization (ISH), microarray, and Southern or northern blot. In situ hybridization (ISH) is a type of hybridization that uses a labeled complementary DNA or RNA strand as a probe to localize a specific DNA or RNA sequence in a portion or section of tissue (in situ), or, if the tissue is small enough, the entire tissue (whole mount ISH). DNA ISH can be used to determine the structure of chromosomes. RNA ISH is used to measure and localize mRNAs and other transcripts within tissue sections or whole mounts. Sample cells and tissues are usually treated to fix the target transcripts in place and to increase access of the probe. The probe hybridizes to the target sequence at elevated temperature, and then the excess probe is washed away. The probe that was labeled with radio-, fluorescent- or antigen-labeled bases is localized and quantified in the tissue using autoradiography, fluorescence microscopy, and/or immunohistochemistry. ISH can also use two or more probes, labeled with radioactivity or the other non-radioactive labels, to simultaneously detect two or more transcripts. In some embodiments, chromosomal aberrations are detected using fluorescence in situ hybridization (FISH). In some embodiments, FISH assays utilize bacterial artificial chromosomes (BACs). These have been used extensively in the human genome sequencing project (see *Nature* 409: 953-958 (2001)) and clones containing specific BACs are available through distributors that can be located through many sources, e.g., NCBI. Each BAC clone from the human genome has been given a reference name that unambiguously identifies it. These names can be used to find a corresponding GenBank sequence and to order copies of the clone from a distributor.

The use of chromosome-staining dyes and karyotyping is also contemplated by the technology.

In addition, the use of sequencing (e.g., next-generation sequencing) finds use in assessing the number of genes and/or chromosomes corresponding to a particular gene, locus, region, allele, SNP, etc. of interest. Illustrative non-limiting examples of nucleic acid sequencing techniques include, but are not limited to, chain terminator (Sanger) sequencing, dye terminator sequencing, and/or high throughput sequencing methods. The present disclosure is not intended to be limited to any particular methods of sequencing. Those of ordinary skill in the art will recognize that because RNA is less stable in the cell and more prone to nuclease attack experimentally RNA is usually reverse transcribed to DNA before sequencing. A variety of nucleic acid sequencing methods are contemplated for use in the methods of the present disclosure including, for example, chain terminator (Sanger) sequencing, dye terminator sequencing, and high-throughput, massively parallel (e.g., next-generation) sequencing methods including sequencing-by-synthesis and single molecule methods. For example, some embodiments relate to the use of next generation sequencing techniques such as single molecule real time sequencing (e.g., as provided commercially by Pacific Biosciences), sequencing by synthesis (e.g., as provided commercially by Illumina, Inc.), 454 pyrosequencing (e.g., as provided commercially by Roche Diagnostics, Inc.), SOLiD sequencing (e.g., as provided commercially by Life Technologies, Inc.), and ion semiconductor sequencing (e.g., as provided commercially by Life Technologies, Inc.).

In some embodiments, a chromosomal aberration (e.g., an aneuploidy such as trisomy 21) is detected using, e.g., nucleic acid amplification. Illustrative non-limiting examples of nucleic acid amplification techniques include, but are not limited to, polymerase chain reaction (PCR), reverse transcription polymerase chain reaction (RT-PCR), transcription-mediated amplification (TMA), ligase chain reaction (LCR), strand displacement amplification (SDA), and nucleic acid sequence based amplification (NASBA). Those of ordinary skill in the art will recognize that certain amplification techniques (e.g., PCR) require that RNA be reversed transcribed to DNA prior to amplification (e.g., RT-PCR), whereas other amplification techniques directly amplify RNA (e.g., TMA and NASBA).

In some embodiments, dyes and/or fluorescent proteins find use in measuring the length of neuron axons using microscopy.

In some embodiments, aberrant and/or dysregulated expression of a biological molecule, e.g., a Dscam, is detected by measuring the expression of corresponding mRNA in a tissue sample (e.g., nervous tissue).

In some embodiments, aberrant and/or dysregulated expression of a biological molecule, e.g., a Dscam, is detected by measuring the expression of a protein or polypeptide. Protein expression may be detected by any suitable method. In some embodiments, proteins are detected by immunohistochemistry. In other embodiments, proteins are detected by their binding to an antibody raised against the protein. The generation of antibodies is known in the art. Antibody binding is detected by techniques known in the art, e.g., radioimmunoassay, ELISA (enzyme-linked immunosorbant assay), "sandwich" immunoassays, immunoradiometric assays, gel diffusion precipitation reactions, immunodiffusion assays, in situ immunoassays (e.g., using colloidal gold, enzyme or radioisotope labels, for example), Western blots, precipitation reactions, agglutination assays (e.g., gel agglutination assays, hemagglutination assays, etc.), complement fixation assays, immunofluorescence assays, protein A assays, and immunoelectrophoresis assays, etc. In some embodiments, antibody binding is detected by detecting a label on the primary antibody. In another embodiment, the primary antibody is detected by detecting binding of a secondary antibody or reagent to the primary antibody. In a further embodiment, the secondary antibody is labeled. Many methods are known in the art for detecting binding in an immunoassay and are within the scope of the present invention.

Systems

Some embodiments of the technology are related to systems for treating a neurological disorder, e.g., a neurological malady associated with aberrant axonal growth, e.g., Down syndrome, epilepsy, bipolar disorder, or fragile X mental retardation. For example, some embodiments comprise test reagents to detect an aberrant (e.g., dysregulated) Dscam expression and/or activity in a subject and a composition for decreasing the activity and/or expression of a biological component associated with the functions and/or dysfunctions of Dscam (e.g., a biological component that can be modulated to counteract aberrant Dscam expression and/or activity, e.g., Abl kinase). In some embodiments, the test reagent comprises an oligonucleotide probe for assessing the chromosomal state of the subject (e.g., euploid, aneuploid, trisomic (e.g., trisomic for chromosome 21), etc.) and in some embodiments the test reagent comprises one or more amplification primers targeting the DSCAM gene. In some embodiments, the test reagent comprises an antibody specific for Dscam or an epitope of Dscam. In some embodiments, the probe, primer, and/or antibody recognizes a biological molecule having a sequence (or complement thereof) provided in Table 1, Table 2, SEQ ID NO: 1, and/or SEQ ID NO: 2. In some embodiments, the probe, primer, and/or antibody comprises a detectable label (e.g., a fluorescent label).

Further embodiments comprise buffers for providing the test reagent and/or for providing a pharmaceutical formulation from the composition. Some embodiments comprise a computer and/or computer software for analyzing data acquired from the test to detect an aberrant (e.g., dysregulated) Dscam expression and/or activity in a subject and to provide suggested therapies for the subject, e.g., comprising administration of a composition for decreasing the activity and/or expression of a biological component associated with the functions and/or dysfunctions of Dscam (e.g., a biological component that can be modulated to counteract aberrant Dscam expression and/or activity, e.g., Abl kinase).

Kits

Some embodiments provide kits for treating a neurological disorder, e.g., a neurological malady associated with aberrant axonal growth, e.g., Down syndrome, epilepsy, bipolar disorder, or fragile X mental retardation. For example, some embodiments comprise test reagents to detect an aberrant (e.g., dysregulated) Dscam expression and/or activity in a subject. Some embodiments comprise a composition for decreasing the activity and/or expression of a biological component associated with the functions and/or dysfunctions of Dscam (e.g., a biological component that can be modulated to counteract aberrant Dscam expression and/or activity, e.g., Abl kinase). In some embodiments, the test reagent comprises an oligonucleotide probe for assessing the chromosomal state of the subject (e.g., euploid, aneuploid, trisomic (e.g., trisomic for chromosome 21), etc.) and in some embodiments the test reagent comprises one or more amplification primers targeting the DSCAM gene. Further embodiments comprise buffers for providing the test reagent and/or for providing a pharmaceutical formulation from the composition. In some embodiments, the test reagent comprises an antibody specific for Dscam or an epitope of Dscam. In some embodiments, the probe, primer, and/or antibody recognizes a biological molecule having a sequence provided in Table 1 and/or SEQ ID NO: 1, a transcription product of a sequence provided in Table 1 and/or SEQ ID NO: 1, and/or a translation product of a sequence provided in Table 1 and/or SEQ ID NO: 1. In some embodiments, the probe, primer, and/or antibody comprises a detectable label (e.g., a fluorescent label).

In some embodiments, the test reagent comprises an antibody specific for Abl or an epitope of Abl. In some embodiments, the probe, primer, and/or antibody recognizes a biological molecule having a sequence provided in Table 2 and/or SEQ ID NO: 2, a transcription product of a sequence provided in Table 2 and/or SEQ ID NO: 2, and/or a translation product of a sequence provided in Table 2 and/or SEQ ID NO: 2. In some embodiments, the probe, primer, and/or antibody comprises a detectable label (e.g., a fluorescent label).

In some embodiments, components of a kit are provided in a desiccated and/or lyophilized form. In some embodiments, kits comprise components for administration of a composition for decreasing the activity and/or expression of a biological component associated with the functions and/or dysfunctions of Dscam (e.g., a biological component that can be modulated to counteract aberrant Dscam expression and/or activity, e.g., Abl kinase), e.g., a syringe, pill former, cannula, etc.

EXAMPLES

Experiments were performed using *Drosophila* as a model organism to identify the molecular signaling mechanism underlying the axon terminal overgrowth caused by increased Dscam levels. Specifically, experiments were performed using *Drosophila* class IV dendritic arborization (C4da) neurons, which is a well-established system for studying neuronal development. The cell bodies of C4da neurons are located on the larval body wall and they send axons to the ventral nerve cord (VNC), collectively forming a ladder-like structure. At the level of single neuron, the axon terminals comprise anterior, contralateral, and, occasionally, posterior branches (Kim et al. (2013) *Neuron* 78: 827-838). Previous experiments demonstrated that overexpression of Dscam in C4da neurons induces overgrowth of axon terminals (see, e.g., FIGS. 1C and 2B).

Unless indicated otherwise, the materials used in the following examples included the following: an enhanced chemiluminescence kit purchased from Thermo Scientific. Rhodamine Red-X-conjugated donkey anti-rabbit IgG, Alexa Fluor 488-conjugated donkey anti-chicken IgY, horseradish peroxidase-conjugated goat anti-rabbit IgG, and goat anti-mouse IgG were from Jackson ImmunoResearch, Inc. (West Grove, Pa.). Primary antibodies used were mouse anti-tubulin antibody (DM1A, Sigma-Aldrich, St. Louis, Mo.), rabbit anti-phospho-Abl antibody (Cell Signaling Technology, Danvers, Mass.), mouse anti-GFP antibody (JL-8, Clontech, Mountain view, Calif.), chicken anti-GFP antibody (Ayes labs, Inc. Tigard, Oreg.), rabbit anti-RFP antibody (Rockland, Gilbertville, Pa.), and mouse anti-phosphotyrosine antibody (4G10, Millipore, Temechula, Calif.). Schneider's *Drosophila* Medium and Lipofectamine 2000 were from Life Technologies. Nilotinib was purchased from Abcam.

*Drosophila* strains used are: UAS-Abl (*Drosophila* Abl), UAS-BCR-Abl (Wills et al (1999) *Neuron* 22: 301-312); UAS-Dscam[TM2] (Kim et al. (2013) *Neuron* 78: 827-38); abl$^1$ (Gertler et al (1989) *Cell* 58: 103-13); abl$^4$ (Bennett and Hoffman (1992) *Development* 116: 953-66); ppk-Gal4 (Kuo et al. (2005) *Proc. Natl. Acad. Sci. USA* 102: 15230-15235), UAS-Dscam[3.36.25.2]:GFP (Yu, et al. (2009) *J Neurosci* 29: 1904-14), and dFMRP$^{\Delta 50}$ (Zhang, et al., 2001). w$^{1118}$ was used as wild-type control throughout the experiments described herein.

To prepare the UAS-Abl plasmid, the full-length cDNA of *Drosophila* Abl was obtained by ligating two fragments amplified by polymerase chain reactions (PCR) from genomic DNA of UAS-Abl transgenic *Drosophila* (Wills et al. (1999) *Neuron* 22: 301-312). The two fragments amplified from the genomic DNA were inserted piece-wise into the pUAST-attB vector (Bischof et al. (2007) *Proc. Natl. Acad. Sci. U.S.A.* 104(9) 3312-3317). The first fragment of Abl was amplified by PCR from genomic DNA using the following primers:

```
sense
                                     (SEQ ID NO: 3)
5' TGAATGCGGCCGCATGGGGGCTCAGCAGGGCGAAG 3' antisense
                                     (SEQ ID NO: 4)
5' GACTGCTCGAGAGCAGGCTGGTTC 3'
```

Fragments and vector were digested with the restriction enzymes NotI and XhoI and then ligated. The second fragment was then amplified by PCR from genomic DNA using the following primers

```
sense
                                     (SEQ ID NO: 5)
5' CTGCTCTCGAGCAGTCGGGACTCC 3' antisense
                                     (SEQ ID NO: 6)
5' AGTCTAGATTACCTGTTAAGCGCATTGGAGATCTGACG 3'
```

The second fragment and the pUAST-attB vector already containing the first fragment were both digested with the restriction enzymes XhoI and XbaI and ligated together to produce the pUAST-attB-Abl (UAS-Abl) plasmid.

To generate pUAST-attB-Abl-Myc for expression in S2 cells, the coding region of Abl was recovered from UAS-Abl transgenic flies by PCR, subcloned into pUAST-attB-Myc by using InFusion following manufacturer's protocol (Clontech). Dscam[3.36.25.2]:GFP was previously generated as described (Kim et al. (2013) Neuron 78: 827-38). To generate UAS-DscamΔCyto, the Dscam coding region was digested with SstI and ligated to the GFP coding region. Transgenic flies carrying UAS-DscamΔCyto were generated by P element-mediated germline transformation with support from BestGene, Inc.

Drosophila Schneider 2 cells were maintained in Drosophila Schneider's medium (Life Technologies) supplemented with 10% fetal bovine serum (Sigma-Aldrich, St. Louis, Mo.) in a humidified atmosphere at 26° C. Cells grown on tissue culture plates were transfected with Lipofectamine 2000 (Life Technologies) according to manufacturer's recommendation. Cells were harvested two days after transfection, lysed in SDS sample buffer, and subjected to western blot analysis. In some experiments, cells were transfected with indicated DNA constructs together with tubulin-Gal4 (Lee and Luo, 2001) by using Lipofectamine 2000 (Invitrogen) according to manufacturer's protocol.

Drosophila strains were maintained in standard cornmeal food at 25° C.

The MARCM technique was used to generate and label C4da neurons homozygous for abl[1] or abl[4] mutations and C4da neurons overexpressing Dscam[TM2]:GFP. MARCM clones were induced as previously described in Ye et al. (2011) Journal of Neuroscience 31: 3309-3319. Confocal images were collected and analyzed as described in Kim et al. (2013) Neuron 78: 827-838. The MARCM technique was used to visualize single neurons homozygous for abl[1], abl[4], or dFMRP[Δ50] and overexpressing Dscam[3.36.25.2]:GFP as previously described (Kim, et al., 2013).

Immunostaining of third-instar larvae was accomplished as previously described (Ye, et al., 2011). Antibodies used include chicken anti-GFP (Ayes) and rabbit anti-RFP (Rockland). Samples were dehydrated and mounted with DPX mounting media (Electron Microscopy Sciences). Confocal imaging was completed with a Leica SP5 confocal system equipped with a resonant scanner and 63× oil-immersion lens (NA=1.40). Images were collected and quantified as previously described (Kim, et al., 2013).

To perform co-immunoprecipitation, transfected S2 cells were harvested and lysed on ice with lysis buffer (50 mM Tris-HCl, 150 mM NaCl, 2 mM sodium orthovanadate, 10 mM sodium fluoride, 1% Triton X-100, 10% glycerol, 10 mM imidazole and 0.5 mM phenylmethylsulfonyl fluoride). Lysates were centrifuged for 15 min at 20,000×g, 4° C. and the resulting supernatant was incubated with Protein A/G PLUS-Agarose beads (Santa Cruz Biotechnology) conjugated to mouse monoclonal anti-GFP clone 20 (Sigma) for four hrs at 4° C. After washing once with lysis buffer, twice with lysis buffer containing 0.1% deoxycholate, and three times with lysis buffer lacking Triton X-100, the immunoprecipitates and total lysates were resolved on 7.5% SDS-PAGE gels followed by western blot analysis as previously described (Kim, et al., 2013). For western analysis on larval brain lysates, brains were dissected from 3rd-instar larva into ice-cold PBS containing 2 mM sodium vanadate and then lysed by vortexing. Larval brain lysates were resolved on 7.5% SDS-PAGE gels followed by western blot analysis as previously described (Kim, et al., 2013). Primary antibodies used were mouse monoclonal anti-tubulin (Sigma), mouse anti-Myc (Sigma), mouse monoclonal anti-Aequorea Victoria GFP JL-8 (Clontech), and rabbit anti-phospho-c-Abl Tyr412 (Cell Signaling).

Western blot analysis was performed as follows. Proteins were separated on 10% or 7.5% SDS-PAGE, transferred onto nitrocellulose membrane (Watmann), and blocked with 5% skimmed milk in TTBS buffer (50 mM Tris/HCl, pH 7.5, 150 mM NaCl, 0.01% Tween-20). Then, membranes were incubated with primary antibodies overnight, washed three times with TTBS, incubated with secondary antibodies conjugated with horseradish peroxidase for 1 hour at room temperature, and washed three times with TTBS. Blots were visualized with enhanced chemiluminescence according to manufacturer's recommendations.

Nilotinib (Abcam) was dissolved in dimethyl sulfoxide (DMSO) at 94 mM. S2 cells transfected with Myc-Abl were treated with either nilotinib (e.g., 0-100 µM; see, e.g., FIG. 4) or the same volume of DMSO as a vehicle control for six hours before harvested and subjected to western blot analysis (see, e.g., FIG. 4). MARCM technique was used to generate and visualize mutant single C4da neurons as described above except that Drosophila embryos were collected and raised for four days on standard corn meal food containing either 380 µM nilotinib or DMSO. Sample preparation, imaging, and quantification were then completed as described above.

Two-way Student's t-test was used for statistical analysis. *: $p<0.05$; : $p<0.01$; *: $p<0.001$; ****: $p<0.0001$; ns: not significant.

Example 1

During the development of embodiments of the technology provided herein, experiments were performed to assess the overexpression of Abl in Drosophila neurons. Experiments were performed in the Drosophila larval class IV dendritic arborization (C4da) neurons. These neurons are nociceptors that mediate larval avoidance of potentially harmful stimuli (Hwang, R. Y., Zhong, L., Xu, Y., Johnson, T., Zhang, F., Deisseroth, K., Tracey, W. D. 17 (2007) 2105-2116.). The cell body and dendrites of each C4da are located in the larval body wall, with the dendrites fanning out to fill the body wall. These neurons are segmentally repeated, and their axons project to the ventral nerve cord (VNC) at a regular interval. Upon reaching the VNC, C4da synaptic terminals branch into anterior, posterior, and contralateral projections that together form a ladder-like structure. In these experiments, C4da neurons were labeled with membrane GFP (mCD8:GFP) driven by a C4da-specific driver (pickpocket-Gal4 or ppk-Gal4). Images were acquired of axon terminals from wild-type, Abl overexpressing (OE Abl), or Dscam overexpressing (OE Dscam) C4da neurons. Data collected from these experiments indicated that Abl overexpression in C4da neurons caused axon overgrowth that recapitulated the effect of Dscam overexpression (FIG. 1).

Example 2

During the development of embodiments of the technology provided, experiments were conducted to test the nature of the functional relationship between Dscam and Abl. In particular, genetic mosaic experiments were performed to label axon terminals of single C4da neurons in mutant and wild-type (control) genetic backgrounds.

Figure 2:
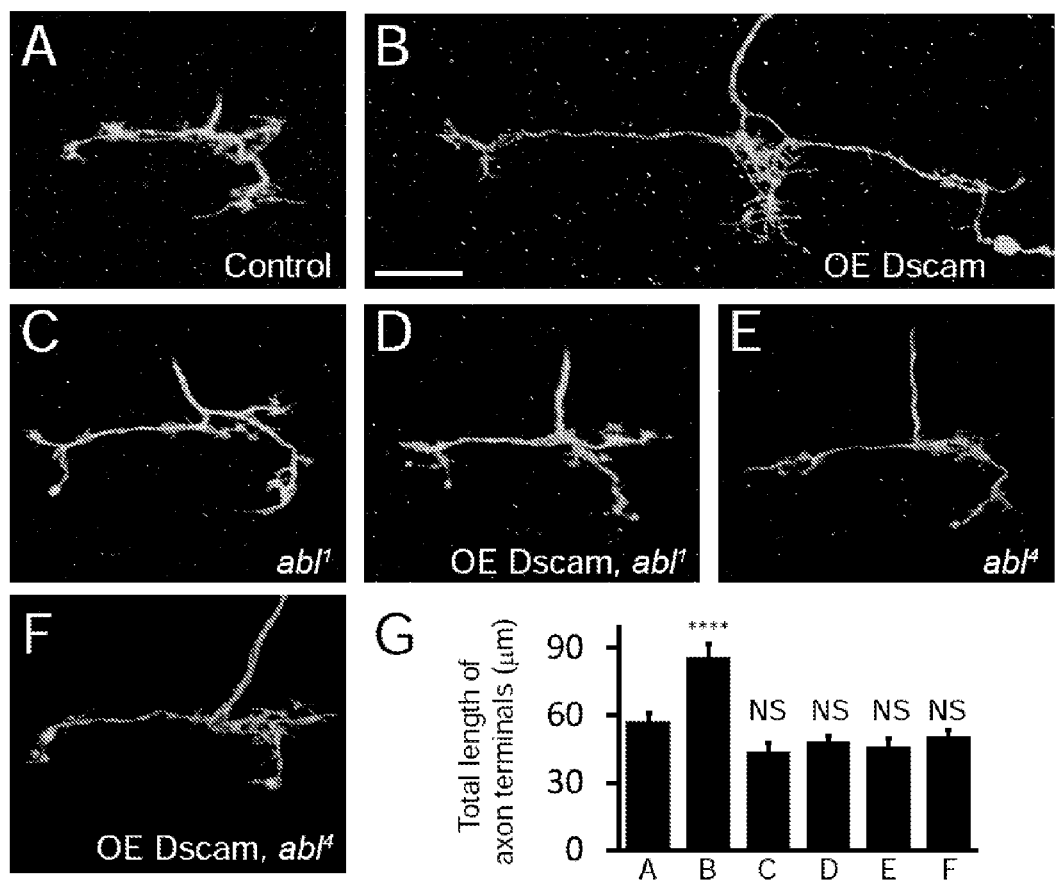
FIG. 2 is a series of images and a plot showing that genetic loss of Abl function suppresses the axon terminal overgrowth caused by Dscam overexpression.

The Dscam transgene was expressed in single C4da neurons using the MARCM technique (see, e.g., Lee and Luo (1999) Neuron 22: 451). Mutants tested included a mutant that overexpressed Dscam (OE Dscam), a mutant that is genetically homozygous for the abl mutations $abl^1$ and $abl^4$, and a mutant that overexpressed Dscam in an abl mutant genetic background (OE Dscam, abl). The mutants $abl^1$ and $abl^4$ are two independent loss-of-function mutant alleles. The size of axon terminals was quantified in images by measuring the total length of axon terminals. Data collected indicated that Dscam overexpression (OE Dscam) caused overgrowth of axon terminals, which was completely suppressed by abl mutations (FIG. 2).

Figure 3:
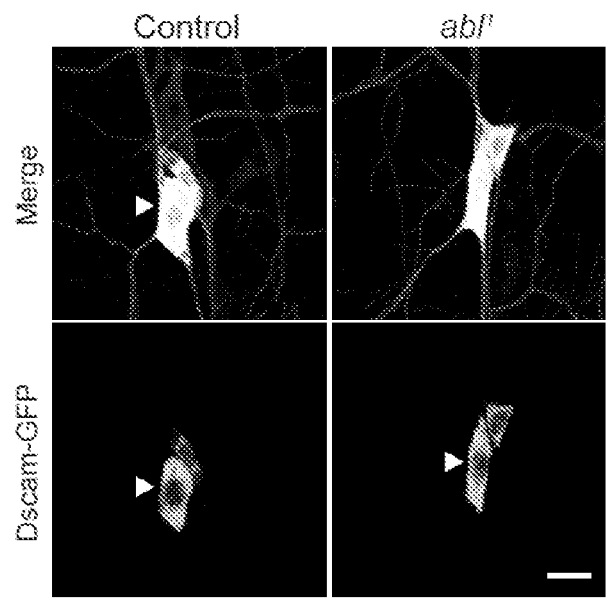
FIG. 3 is a series of images and a plot showing that abl mutations do not affect the expression levels of the Dscam transgene. Dscam:GFP was expressed in C4da neurons by the C4da-specific driver pickpocket (ppk)-Gal4 along with cell membrane-tagged monomeric red fluorescent protein (RFP) (mCD8:RFP) in wild-type (FIG. 3A, lower left) or abl loss-of-function genetic background (abl[1]) (FIG. 3A, lower right). GFP intensity was measured from C4da neuron cell bodies, normalized by RFP intensity, and presented in the bar chart shown in FIG. 3B. No significant difference in Dscam expression (arbitrary fluorescence units (AU)) was observed in control neurons relative to abl[1] neurons. Scale bar=10 μm. NS, $P>0.05$, two-tailed Student t-test.
Figure 3:
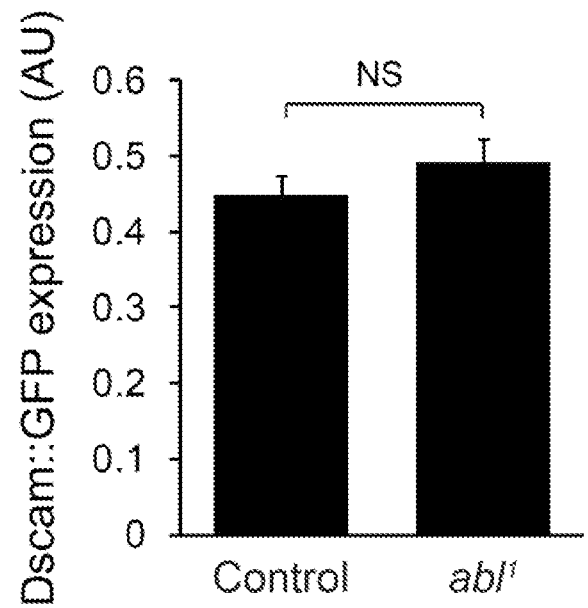

In additional experiments, data indicated that abl mutations did not affect the expression levels of the Dscam transgene, indicating that the rescue of the axon defects was not due to an interference with transgene expression but rather from inhibiting the aberrant function of Dscam at increased protein levels (FIG. 3). Dscam::GFP was expressed in C4da neurons by the C4da-specific driver ppk-Gal4 along with membrane RFP (mCD8:RFP) in a wild-type or an ab/loss-of-function background ($abl^1$). Dscam expression levels (as indicated by GFP intensity) were measured from the C4da neuron cell body (FIG. 3). Collectively, the data indicate that the overgrowth of axon terminals caused by increased Dscam protein levels depends on the presence of Abl.

Example 3

Figure 4:
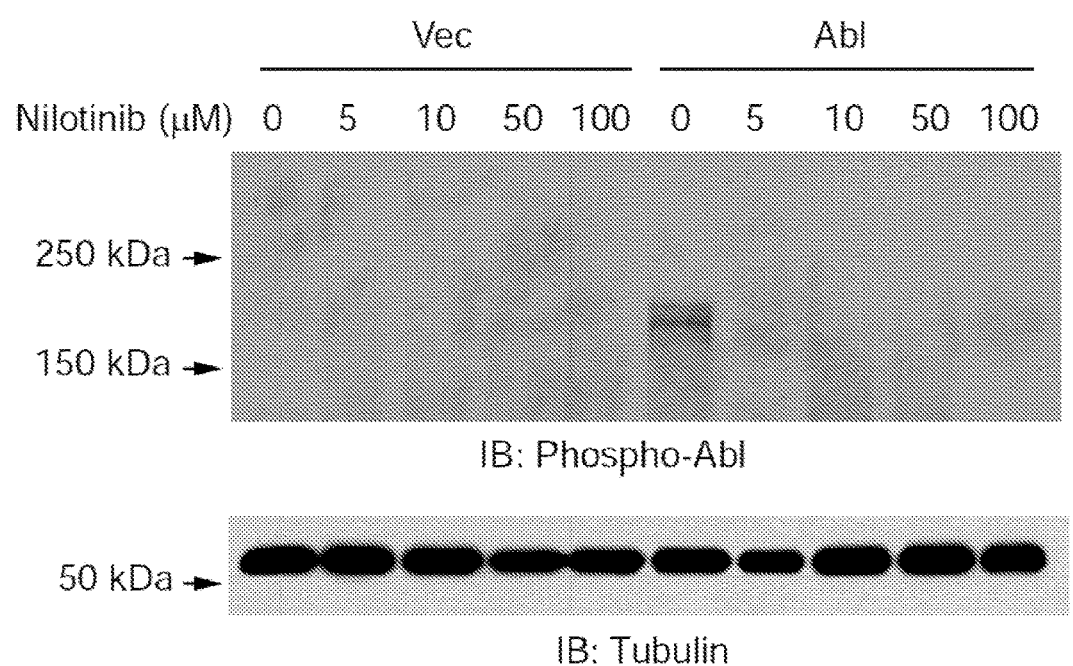
FIG. 4 is an immunoblot (western blot) showing that nilotinib effectively suppresses the activity of *Drosophila* Abl in cell culture. cDNA of *Drosophila* Abl was expressed in cultured Schneider 2 (S2) cells; a plasmid vector-only control was used for comparison. Cells expressing vector alone ("Vec", left 5 lanes on the blot) or expressing Abl ("Abl", right 5 lanes on the blot) were treated with the indicated concentrations of nilotinib (at 0 μM (control), 5 μM, 10 μM, 50 μm, and 100 μm) for 6 hours. Abl activity was assessed by western blotting analysis with an anti-phospho-Y412-Abl antibody. Abl activity was suppressed at a nilotinib concentration of 5 μM. Tubulin levels were analyzed by western blot using an anti-tubulin antibody to ascertain that comparable amounts of cell lysates were loaded for each sample.

During the development of embodiments of the technology provided herein, experiments were performed to assess the effects of Abl kinase inhibitors on Dscam-induced axonal overgrowth. The second-generation Abl kinase inhibitor, nilotinib, is a potent cancer drug that is capable of crossing the blood-brain barrier. cDNA of *Drosophila* Abl was expressed in cultured Schneider 2 cells. Cells were treated with nilotinib at 0 μM (control), 5 μM, 10 μM, 50 μM, and 100 μM for 6 hours. Abl activity was assessed by western blotting analysis with an anti-phospho-Y412-Abl antibody. Data were collected indicating that nilotinib effectively inhibited the activity of *Drosophila* Abl (FIG. 4). In particular, Abl activity was completely suppressed (e.g., completely suppressed, undetectable, essentially suppressed, and/or substantially suppressed) at a nilotinib concentration of 5 μM.

Figure 5:
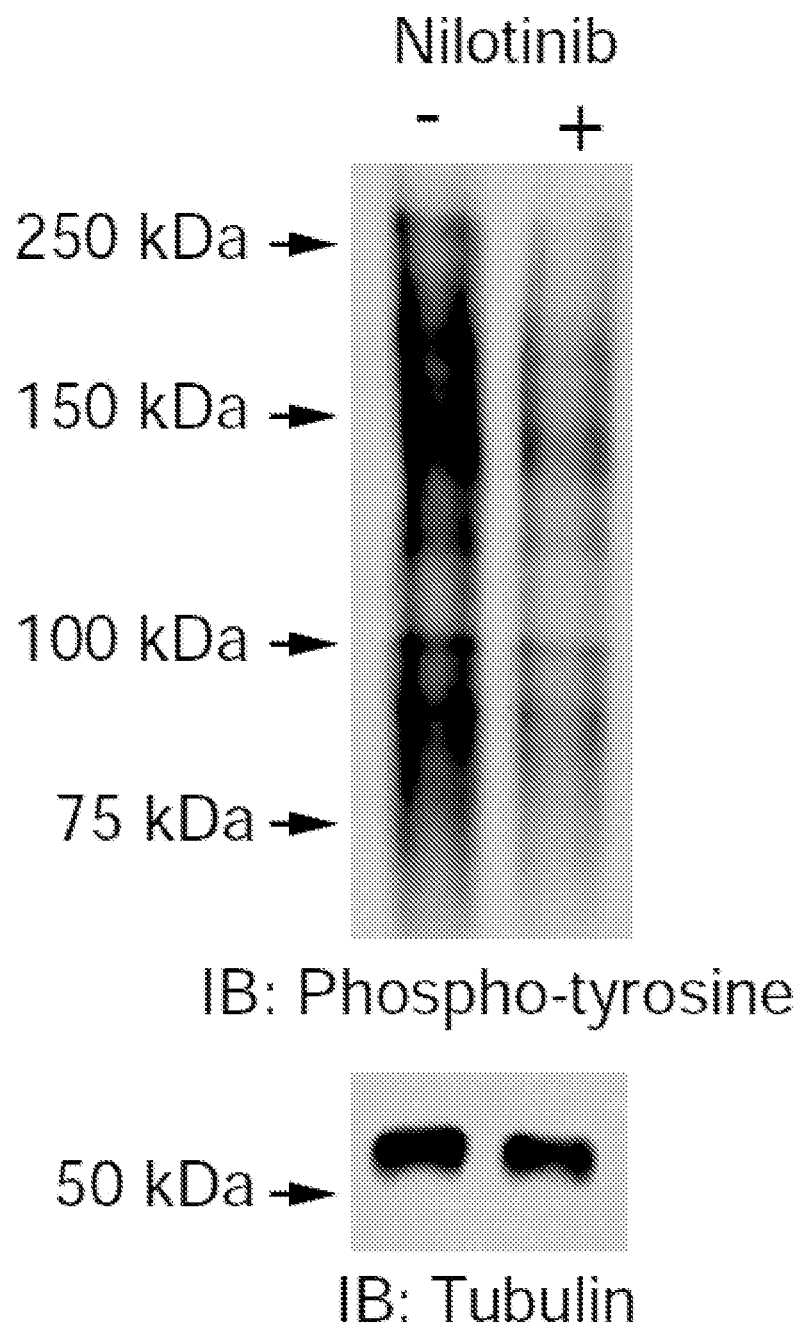
FIG. 5 is an immunoblot (western blot) showing that nilotinib effectively suppresses Abl tyrosine kinase activity in the *Drosophila* central nervous system in vivo. Wild-type *Drosophila* larvae were reared in food containing either vehicle or 0.4 mM nilotinib for 4 days. Larval brains were removed and subjected to western blot analysis with anti-phosphotyrosine antibody. The blots indicated that nilotinib lowered the amount of phospho-tyrosine in the *Drosophila* larval brain tissue. Tubulin protein levels were analyzed by western blot using an anti-tubulin antibody to ascertain that comparable amount of cell lysates were loaded for each sample in the western blot.

Then, experiments were conducted to assess the in vivo efficacy of nilotinib by feeding *Drosophila* larvae with food containing 380 μM nilotinib for 4 days. Larval brains were removed and subjected to western blot analysis with anti-phosphotyrosine antibody. Examination of tyrosine phosphorylation patterns on the western blots indicated that nilotinib effectively suppressed tyrosine phosphorylation in vivo (FIG. 5).

Figure 6:
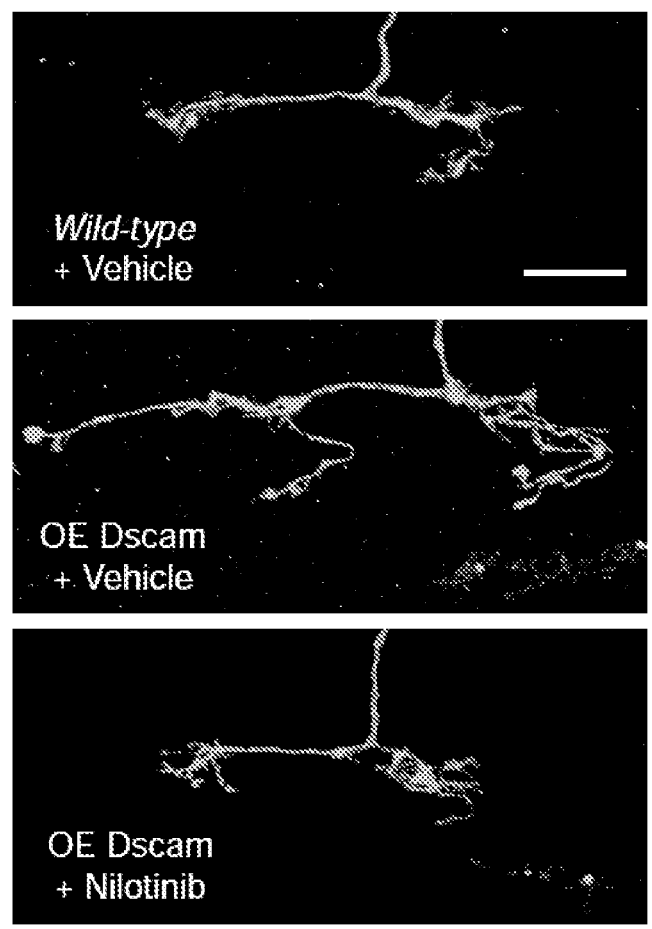
FIG. 6 is a series of images and a plot showing that nilotinib suppresses axon terminal overgrowth induced by overexpression of Dscam. The genetic technique MARCM was used to express the Dscam transgene in single C4da neurons and to label the morphology of the axon terminals. *Drosophila* larvae containing MARCM-induced C4da neurons were reared in food containing either vehicle or 0.4 mM nilotinib for 4 days. Images were acquired from axon terminals of wild-type C4da neurons (FIG. 6A, top image), C4da neurons overexpressing Dscam and treated with vehicle alone (FIG. 6A, middle image), and C4da neurons overexpressing Dscam and treated with nilotinib (FIG. 6A, bottom image).
Figure 6:
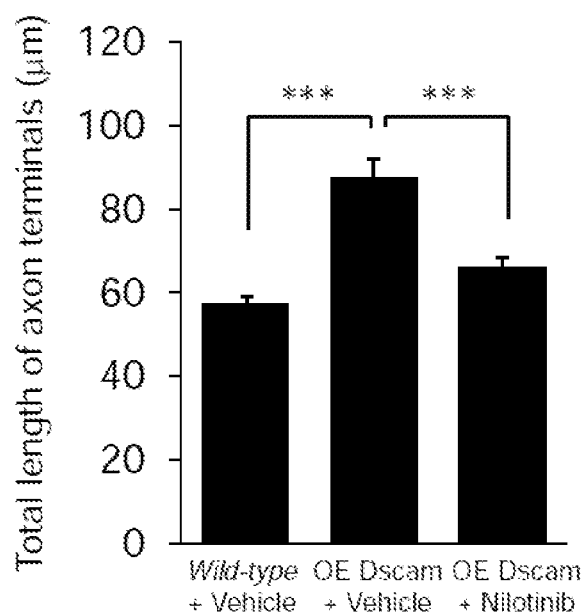
Figure 7:
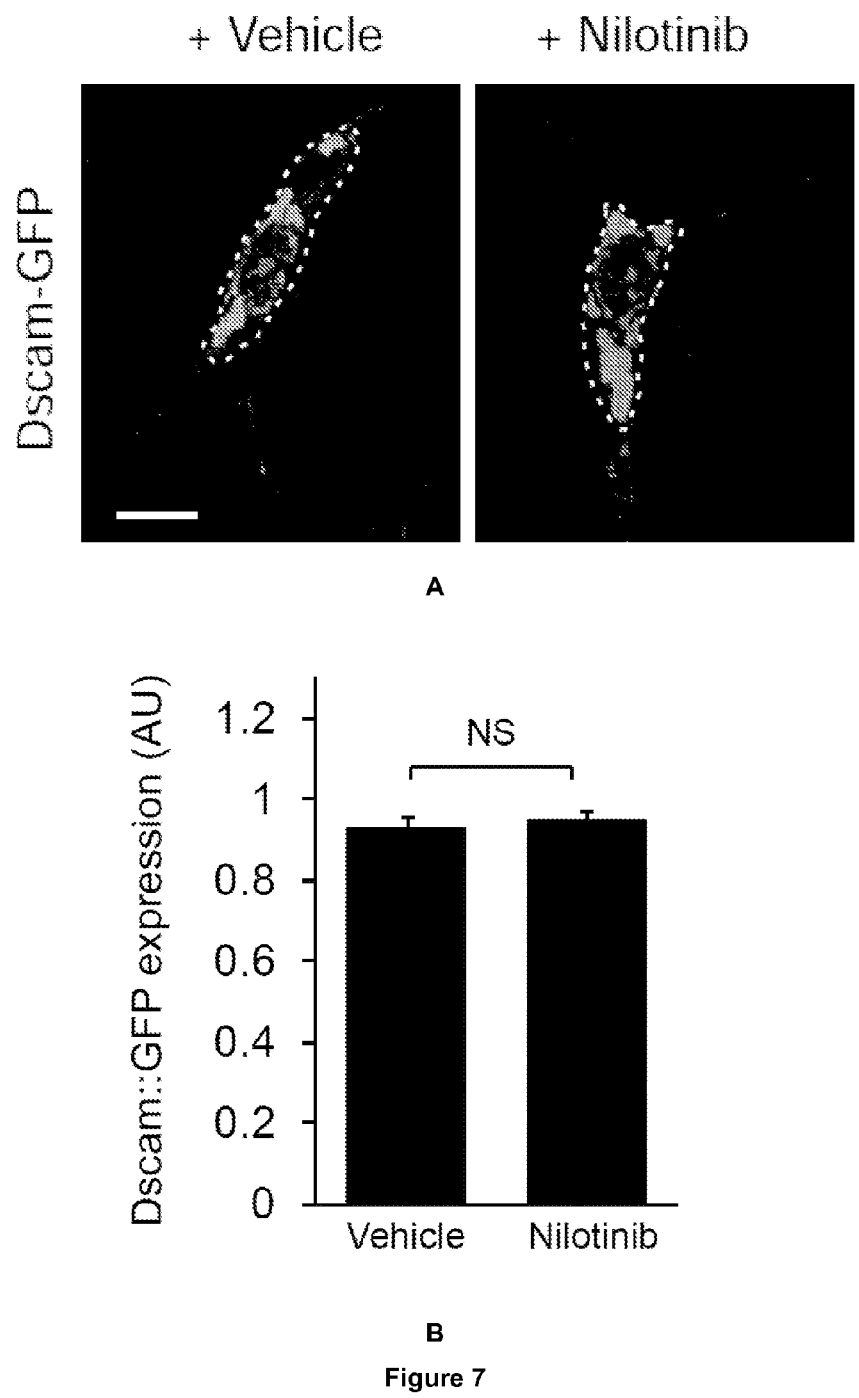
FIG. 7 is a series of images and a plot showing that nilotinib does not affect the expression levels of Dscam transgene in vivo. *Drosophila* larvae were raised on food containing either vehicle or 0.4 mM nilotinib. Expression of Dscam transgene was achieved by the C4da-specific driver ppk-Gal4 and UAS-Dscam:GFP transgenes. GFP intensity was measured from C4da neuron cell bodies treated with vehicle or nilotinib (FIG. 7A) and the Dscam intensity was quantified (FIG. 7B). No significant difference in Dscam expression was observed in neuron treated with vehicle alone relative to neurons treated with nilotinib. Scale bar=5 μm. NS, $P>0.05$, two-tailed Student t-test.

In addition, nilotinib feeding (e.g., at concentration of 380 μM) nearly completely suppressed Dscam-induced axon terminal overgrowth (FIG. 6) without affecting the expression of the Dscam transgene (FIG. 7). In particular, the genetic mosaic analysis MARCM was used to express the Dscam transgene in single C4da neurons and to label the morphology of the axon terminals. *Drosophila* larvae containing MARCM-induced C4da neurons were reared in food containing either vehicle or 380 μM nilotinib for 4 days. Expression of Dscam transgene was achieved by the C4da-specific driver ppk-Gal4 and UAS-Dscam::GFP transgenes. The larvae were reared in food containing either vehicle or 380 μM nilotinib for 4 days. Dscam expression levels (GFP intensity) were measured from the C4da neuron cell body. The data collected indicated that inhibiting Abl kinase activity with nilotinib mitigates the neuronal defects caused by increased Dscam expression.

Example 4

Figure 9:
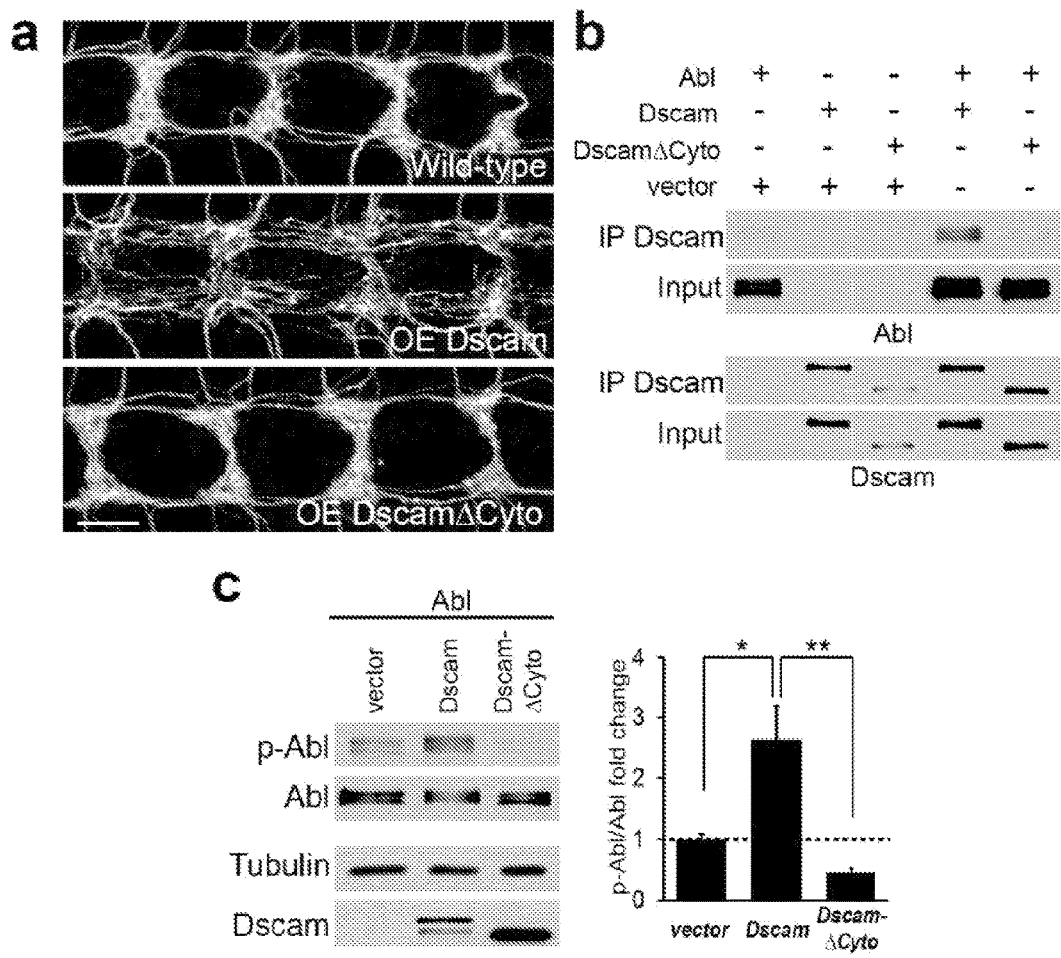
FIG. 9 is a series of images and immunoblots indicating that Dscam binds to Abl to activate Abl kinase activity.

During the development of embodiments of the technology provided herein, experiments were conducted to examine the interaction of Abl with Dscam signaling. Abl can be activated by binding to specific proteins, such as the cytoplasmic domains of membrane receptors (Bradley and Koleske (2009) *Journal of cell science* 122: 3441-54). Since overexpression of Dscam in C4da neurons causes exuberant axon terminal overgrowth (FIG. 9a, middle ("OE Dscam")), we used this technique to test the requirement of the Dscam cytoplasmic domain. Overexpressing a mutant Dscam that lacked most of the cytoplasmic domain (DscamΔCyto) did not cause axon terminal overgrowth (FIG. 9a, bottom ("OE DscamΔCyto")), suggesting that the cytoplasmic domain is required for Dscam to instruct axon terminal growth. Dscam and Abl proteins co-immunoprecipitated from transfected *Drosophila* Schneider 2 (S2) cells expressing these two proteins (FIG. 9b). In contrast, DscamΔCyto did not co-immunoprecipitate with Abl (FIG. 9b). These results suggest that Dscam and Abl proteins form a complex through Dscam's cytoplasmic domain.

In mammals, autophosphorylation of Abl at Tyr245 and Tyr412 stabilizes the active conformation of the kinase (Brasher and Van Etten (2000) *Journal of Biological Chemistry* 275: 35631-7; Tanis et al. (2003) *Mol Cell Biol* 23: 3884-96). As a result, phospho-specific antibodies raised against Tyr412 (Y412) have been employed to detect active Abl kinases (Brasher and Van Etten, supra). This approach has been used successfully to recognize the phosphorylation of the corresponding tyrosines (Tyr 539/522) in *Drosophila* as an assay for Abl kinase activation (Stevens, et al. (2008) *Mol Biol Cell* 19: 378-93). Since the ability of Abl to instruct axon terminal growth relies on Abl kinase activity, experiments were conducted to examine whether Dscam activates Abl. Data collected indicated that although the presence of Dscam did not affect Abl expression level, Abl kinase activation was significantly increased (approximately 2.6× (e.g., 2.6-fold)) when Abl and Dscam were co-expressed (FIG. 9c). These results suggest that Dscam enhances Abl kinase activity. Furthermore, data indicated that, unlike wild-type Dscam, DscamΔCyto did not change the Abl kinase activation (FIG. 9c). These results indicate that Dscam cytoplasmic domain is required for Abl activation, possibly through a physical interaction with Abl.

Example 5

Figure 10:
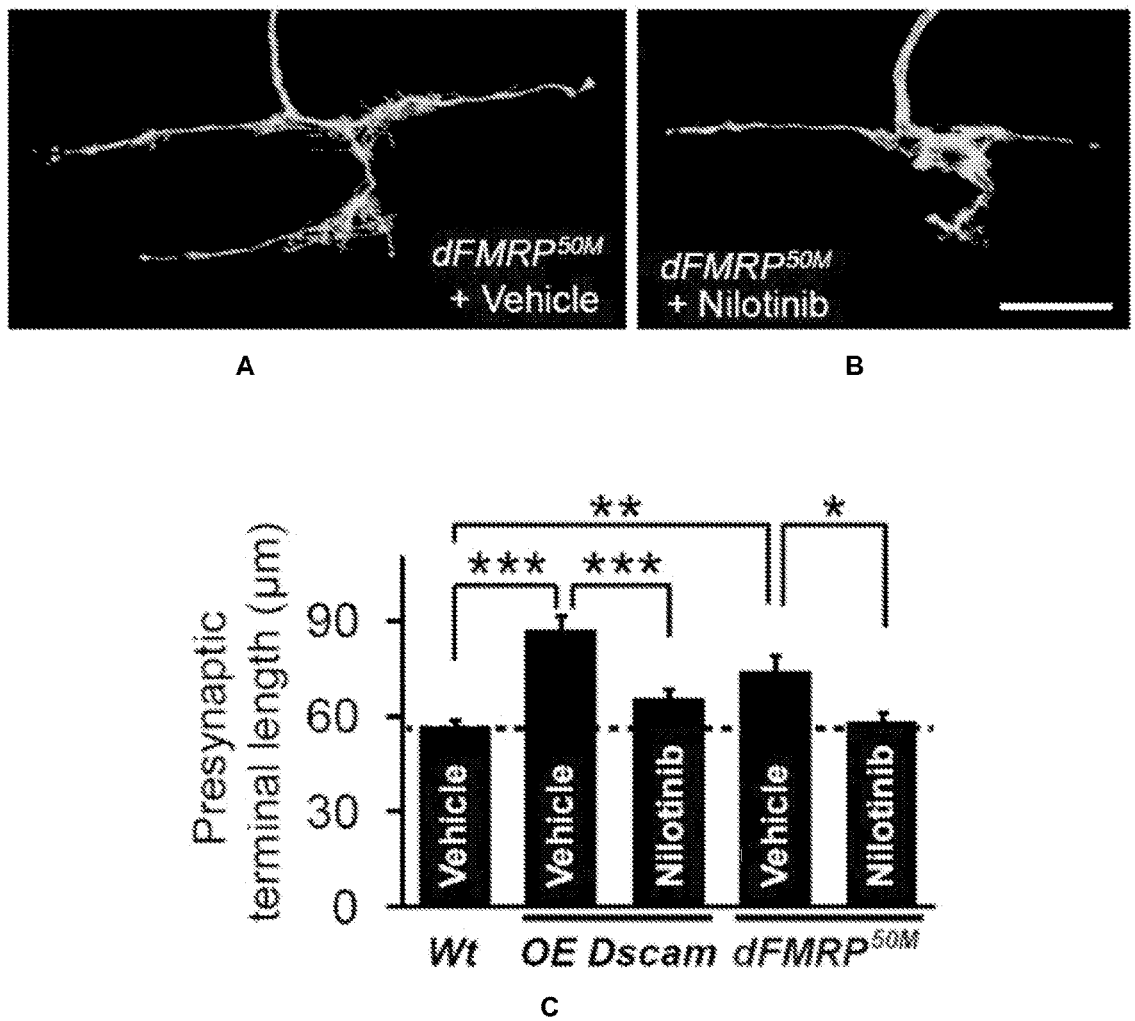
FIGS. 10A and 10B are images indicating that pharmacological inhibition of Abl mitigates the neuronal defects caused by increased Dscam expression in vivo.
FIG. 10c summarizes the data from FIG. 6, FIG. 10A and FIG. 10B relating to quantification of the axon terminal length of the indicated genotype and drug treatment. Wild-type+vehicle: n=31; overexpression of Dscam (OE Dscam)+vehicle: n=30; OE Dscam+nilotinib: n=32; dFMRP[50M]+vehicle; n=22; dFMRP[50M]+nilotinib: n=18. Scale bar is 10 μm. Two-way Student's t-test was used for statistical analysis. *: $p<0.05$; : $p<0.01$; *: $p<0.001$; ****: $p<0.0001$.

During the development of embodiments of the technology provided herein, experiments were conducted to examine the efficacy of nilotinib treatment in a model of a disease associated with dysregulated Dscam expression. Fragile X Syndrome (FXS) is caused by an absence of Fragile X mental retardation protein (FMRP) (Kremer, et al. (1991) Science 252: 1711-14), and is modeled in Drosophila using loss-of-function mutants for the Drosophila homolog of FMRJ, dFMRP (Zhang, et al. (2001) Cell 107:591-603; Dockendorff, et al. (2002) Neuron 34: 973-84). It has previously been shown that FMRP binds to Dscam mRNA in both mammals and Drosophila (Darnell, et al. (2011) Cell 146: 247-61; Cvetkovska, et al. (2013) Nature Neuroscience 16: 677-U36; Kim, et al. (2013), supra) and that dFMRP represses Dscam expression to control axon terminal growth (Cvetkovska, et al. (2013), supra; Kim, et al. (2013), supra), so that dFMRP mutants exhibit increased axon terminal length in C4da neurons (Kim, et al. (2013), supra). Thus, experiments were conducted to test whether administration of nilotinib could rescue the axon terminal overgrowth caused by pathological increase of Dscam expression in dFMRP mutants. Data collected indicated that, while dFMRP mutants fed vehicle showed a significant increase (130%) in axon terminal length (FIG. 10a), administration of nilotinib to dFMRP mutants almost completely rescued (to 103% of control) the exuberant axon terminal growth to wild-type levels (FIG. 10b). These results indicate that pharmacological inhibition of Abl kinase is effective for mitigating the effects of increased Dscam level in an in vivo model of Fragile X Syndrome.

Example 6

During the development of embodiments of the technology described herein, data were collecting indicating that Dscam requires Abl to promote axon terminal growth in vivo and that Abl binding to the Dscam cytoplasmic domain activates Abl kinase activity. Furthermore, data indicated that treating larvae with an Abl inhibitor rescues the morphological defects caused by increased Dscam levels in vivo in both experimental and disease-relevant models. Taken together, these results indicate that Abl is a drug target for the treatment of brain disorders associated with dysregulated Dscam expression, including DS and FXS.

Furthermore, during the development of embodiments of the technology provided herein, experiments in mice indicated that the molecular pathway tested in Drosophila and described in the experiments above is conserved in the development of the mouse cerebral cortex. In particular, Dscam overexpression in migrating neurons in developing mouse cerebral cortex produces abnormal migration of these neurons, and reducing Abl levels in these neurons rescues the neuronal migration defects caused by Dscam overexpression. Accordingly, the Dscam-Abl link discovered in Drosophila is conserved in Mus. Further, the mouse provides an assay system for testing compounds and other therapeutic agents to modulate neuronal development (e.g., neuronal development deficits) associated with Dscam overexpression.

All publications and patents mentioned in the above specification are herein incorporated by reference in their entirety for all purposes. Various modifications and variations of the described compositions, methods, and uses of the technology will be apparent to those skilled in the art without departing from the scope and spirit of the technology as described. Although the technology has been described in connection with specific exemplary embodiments, it should be understood that the invention as claimed should not be unduly limited to such specific embodiments. Indeed, various modifications of the described modes for carrying out the invention that are obvious to those skilled in the art are intended to be within the scope of the following claims.

SEQUENCE LISTING (6 sequences)

SEQ ID NO: 1 - DNA, 834697 bp, Homo sapiens
tgactgaggccggagcacggcaaagatgagcctgcccgcccgcctgctgcctggatgcggagggtgagggctggcgcacgggaggccgctggctgcgcattctgggcgccgagtgcccgggatgagctcacgcccgcgtctgcggctctctccacctgccgacctgccgggggcccactgagctgacggcgcacctgggctccggccgcagcgtggggcgcggcgcccgggagcaggtgtgcaggagcgcagcgcgcggcgagcgcagccctcgctccggagcccggccgcgccgcgtgcccgggcggctaggcagcggcggcggcggcggcgggcggcgggcgggcggcggcccccgggcaggtgccgagcggcgagcggagccgggccgggcggagcgcggggggcgaggccggcgcgtcgctcgcgggaggccggggagcggcaggggcatgtggatactggctctctccttgttccagagcttcgcgaatggtgagcctttcggtttgtgatgaatttcgtttccttatcattgaccgggggggcgggggggtggggggtggcattggatgcatgggtaaagtcttctttctttttccgcttcatctgtgtttaaaatttcgtgcttttatttattttttaaatatcatatttattttttgggggagaagaggtggcaatggagaggcccgggagaaattgctctgtaatcattggaaggcgcttacctagccaagtgacagctcagagcctaactccagtactagagagctgcctcattcagaataaaccaggtttggtgacagaaggagagacaggaagattgccactttgaatattacaacctggaaagggatgtgacattccaagtgcacgcaagtggaggggtcaatgaggaacatctcccttcagattcaatgctttttgagatttttcaaacacgtaatttcatgctagtacaatgtatctccagcaccaaggagggctttaagaatgttctgtccttctatgcaccccgtgctgcttcatgctcctcacagtcgtttatgtaaaaatatgcactgataagcattacatcatctgaaatgttgacaaattaaaaaaaaaaaaacacctgtatagttgtaaaaatgaaatcagtgaatattgtaaatagcatacatttcctcatgcccagccaatattatattttgaaatgatttcttcctgggtatttagaaagctattgctcttgactgagtcagacccaattagtaagtgtgactgcaccttaggctgcctgtcaccgcataaatatgaacttacatgtatgaatggcttcctctcttgtgggaaccagaggaaattgtcatcatttgacatcgcctgggagtagctacggcttaaattcccatttcaaattttggaacacacatctgcataaaatgtataacctactgacagttgaaattaaaccattaagcagaatcccctagccagaagagaggagagagagagagagaaagagaggagggagagagagcgagacagacacagagacagagagagagagagagagagagagagagaggagaagaagagaaggtaaaagaagagaagagaggaaatctggcccttgtgagaaaatacgagaagcaaaggggaggctctaagattttcctggaagacacacagggaagctctgtgtgttggctgcaaggcagtgcattttctttgcctacctagacagtgcctaaagaatcagcataccaacaggccagaagaaatgcatgagcattgtcaattttttaaaaaaacggtgactaagaaaaggtagagttgaaagaaggtactatcaaaatgaacatgaaaatgatactttgctctccagtataacctaaagcaaagtgtttgaaactttcattttgagatttcctagcaggaaagaattgcaacaagttctgacaagacacccatctttcccagagggcaccatacctgtcctgtgtcctcctgggaatttcccttcagggacagatgtgcttagggaacatgcggagatgtgtcggggaagtcagccctttctgctcttctgctaatgcgacctcctaagaaatgtagagatgcctacacatgtgttccaaagacacagagccttgacaccctgtttcgcctgtcagggagtacctttctgaactccttggaaaggcctgggttataagaagaaacaaaatttgcaccccattgggaagtgtgtgtttcaggatgatgaaagaggctgtgctggttgtcagtcagccagtatttatttacagttttagcattttgtatgacaaaatggtatggaagaatttatgatactgatacagactattagcctctgatacagagatgctatatgtgtgtgtgactttttttctgaatcagcattttataactaaaataaacaatcatagaaataattatatatggtaatacaattatatgaaacctcaaatattctgcaatatgaaaaatatatgcaaaaattatgtaggtactcatatagtgagttctgcaagtattattttcaagacttttaaaatcaactgataatcaccattattgtaataaatataggtagattccacaatattagacataaacagcaaacacaaatgaatattttacattgctgtattacgtattctgatccaatctagcagaaggctatggaactgtcttgtataaaaatgcccctctctttatatgatcaaggatgaaaacattaaaagcctgctgtaaagctttaggatctttgaaggggggaggggaaatcagctttaaacagttttctaaggtatggtgttcattacatactggggaaaggatcataaaatatatagacatgttgaaataaaataagaatccagtttggaactatgcctgtttgtaagaccatatttcaaaaatataagagtaaatggtttctacctatctgaattaaactttaaaaaattgagaatatttttgtcaacaactgtcatattttgttatacctcaactttgaaaaatttctgaatgtgtgtgataaaagattgatgaattctaatacctaaactgattattgctaggcctcaagcatcaaaatgcctgacatgataacttttttttttcatttgtaaaagattatgtagtttaatatttggggctattaaaataagcccacaatacatctgcattttaacagtagacaacaatatttttcttattgatgtatcagaagtacagttatttcttaataaaagtatggttgctagacaggctgcaggcagtatttttgaaaaaaaaaaaaaaaaaaagaagaagtcagtgaccaggcccttcataggttaaacccttaaatgaatgacctcacctgatgaggtgcagtatcgtgttttaaagcagtcaatttgttctgcaatgttctggaaatacacgcgagcttctgttacagtgcaaggagccaaggtacacgtatgtgcagacactcacccacacacgtccctcggtgtcttctcagcaaagcttcctactgcattgtgtttcattaccatttctcctggttttaaccccagagcacattctagtttaaaattattgctaaaagaagagccaggccttcagacaaacagaatgatgaagaattagatttattatatgtaatatagttttgctagtatcctggcatctctgtttttacacacacacacacacacacacacacacacacacacacacatgcatgcattcctgacatcatcttttcctgagctgtgggattttcagttctactgcatccgctttcatggggcctgagggtcatggagattagagacggtggggtgctgggagtaagaaggtgctcattaaagagaagatgagtatgcagcacctttgagcttcatccattcacttgataggaaattacagagcacacgcttgctattttatttaattagaagcagacctttgtaaatacaaatgcaccttaaggacttcaaaggtgatttttatttaattcacataaatgtatgtaaggaagaaatgttatcaggtgaacaatttcagggctgcctccacttccctttctcccccatctttattaaacagattaaaaagctatccataatctcagggttcacctaaattccgaggccttttaacttaagctgcatgcccctccaagatgccctctgtaggaaaacaaaatgccacgcagaccttcaataaatgccagtggatcgttctccactttttgactctctcctttgtcattttggtgtgaccacggtttgctgcctcgggggatcagtgagtcacggggggcagaaccagcgcaatacagcattctggtaggggaactaattttgactaaaatatttgccaattctaatccccaattcctggacctccgggtagctggcaaggtattttatgttagatgtgtctggagtaaggtgcacggagtatttcgacaagagactcaattcaatgcgtattaaaacttgattgagagagggagagagagaggtcattttataaagaaagacctgtgaacactgtagattggaaatttatgtttgcaaaataaaaggatgggtttatcaagtggatgcatttacaaaatgtggcatccaggtttcgtaaaattagctgaattctacgggtaagattatgaatgtggctcataaataattaataggtagtgaaaaagaatgtattttgcattaggcagtgcattcaatagtatttcggaaatgagcacttcgatttcctcggtttccatgcgtggcccacctctccagagcagggcaggcacccaggggtgtgcccacacaaacaagcgcgtgtgggcattttcttggctgctgcgctgaagtgcacgctgggccttggtgcccgcaccctcagcctgggagatagggaggtggtgctacctgcaggccgattgtgtccccgccataggacactagtgggcggcaaacctcacaagactcttgcagccagccttcagcagagccagcaaacccagccgccaccgagggaggactgctccatgcagatggtcaggggctttcttctgaagacgcctcccccacgatctctcaagttcactgcgcccaaactccggcgtcgtagagttcgtctaacaggaaccgggcaaaggcaaccgcaggtcaggcgaggtccagcagcctttgttttcaactgtacagcggaggaccgtattcacagcaatatctagaaacctagaaggtgcccagaaaggaaacacaggtgttgcagcgggtagcgggcccgcagaagggtgcatttgcaccccctttccaaagccgcgagggaaccccggcgtggcgcgcgcctcggaggtggcagctccgggagcagctccgcgcctgattggctgaccttccaatgtcattccaggagccgccgcttctcctgctgatggtgacaggggtgatgctgacgtgcccgctcctccgcagtccatcaatctccgcaggcaaggctccgggaccgggagcccccttccctctcccccaggcccactggaaaacacctgttcccctggactggggggttaactcttcaagttccaaagacctgggcacaaaaatgctcatcttatctctccgcgcccctccccccaactatatttatgttcttttcttcaatgttgtgaaaatgccagaaaattcaaagttgcatttcccttgccgaatctatgggttaagataaggcagtgggaatggaagattccagcagccccacggagtatccactatgtcgttctgaattcaaagggtggagcacacggatgttttctgcaggtgacgcaaggtctgtcaaggtggcaggagggaagcagggacaggattttggttcagaggtcagacagcttctgaccaggacgttcagaagggttgggtttcacaaatctgctcctgaaaatcagttccctccatattatcctttttctaaaaatcttggctgtttccttgatggagtctgtggtaatcgttacgcctgcatttaggtgatgctgatttggctagtgactgcctctctcactagctagacaggagcctccatagtctgaaatgcgtgcgaagcctgagcgtgtccttagcacagagcagagcacatggtatggagtagtggaaatagatgatgttccttacggagtgaaaggaaaaagtgataggcagagcctttctcccctccttaactcctgtccaccttcctccctcccgtccacctctctcttctgcctctagctgattggctccccctcttagtttgctttcctggacttgctctcctggtccctatcttgcattctgactaaaccactggactcttttgctctacccacctttttctgtcgtagtgactcaatcacggtagaaatgtttattttccagaaacgcctgtggcttggggcattttcttctcttttcaaaaagagattcatatttcgagtatctgatgggacttcatcactgttgcacaacagctatgtaattgctttaggtgctcttcctgccgtgcagtgggtcaagtgtcacagacaataatttcatccatgtgctggaccccttgttctcaagtgtacgctgctaaatggcatgatttaaaattcctatacagtgtttattgccctgtcgcattttgaaagccagccagaaacatcaaaccgacatttaggttccccgcccactccgccacccccagctcttgggaattcatttcttcatcaaagagccacccaggacatcaaaacaaagcttactttctcaggccttaattcatctttaaaaagtcatactactgttttcttcagcatcctatggatttatgggttttttgtcattatctttatttcttattttgcagattcaaatatgacagttgctatcttcatcaaagtaacatgaaaggatatcttaatcattgttaaagttgatttttgtccaaatataaaaatcaaattaagtgtcttatagcttacaatatttatcagcttttgatttttggacatctctatttgttctatgtgatcaacgctgattttttaaaaatcatgcaactggattaatttttgatcttgaagccccctggattatgtaaatacatattatggtttaacagagagggatgaatgggattgagaagatatatgtcaagatatgaagaaggaaagaggctactacacagagagttagaatgacagggattaatgaatcttgcctgtatccctagttattttttttactgagaagacagtgagtaagatttaagagtgagcaagcagtcctatttatagaaagctgtttttaagtgcagccgcaaagacagtgaaagaaagaattgaaaatgcaagagatcacctccatactaaatgctagcttcccctaacgtcccagctctgtacagcattttgtaggagaaaaaaacaaaaaaaaaagcataccaacccttgcagaaatattatgaaatctctttggactctctgcagaatattctagaagtgctctcagtctttaagtctatgttaggcttgggaagctggggatgagaaggcaatatatatattatctggaaacagcttgagtaggtctgaacaaaagactggaggtgaagggaggacattgaacttgcagcactgctacaaatatttattctgcaataagccttgcctttcttaaagatgtttcacggcagaatagtaggagggtgaaatctgcatacatctcagtaataaagcaattactgagagaagagttcaaatttaggatcctgtgattatcacaagtccctccatgttaacctgttctcaaactctggggttttaaattgcaatatatgaagtccttatttgtcagtctgtgtcgggcagacaatatcaccccaggctttgtgattgacacaaatgttattggacaagggaaaaagaatgccacatgctcttataaatgaaatagtctttataagattccatatataagtgagatcatggattttgtatgtgtgtgtctggcatatatcacttagctaatgtcccccaggttccttaagtatatacaatttagcataaaaaaagaaatgaaatagttttcctttctaggcctgtatttgttacttatagcattctggttttcctggttccaagtgggctttgggttttattaatagtagaatcgttgaatttttatgcaaatactgctgatttacaggttggaaatctggacaaaatcagacctgccctagaagatgatgctgtggaaagtgtttgccttttgtcttataaagaaccatctataaaatggatcattttgtcgctagtctctccagactatgaaattggcattttgataaggtgatggaaagaaatttgaactatttaattactgattttgattcatacaagccttgactcttttagtattaaaatgaagaaacaggaaacagttttaagtctggttttacataaaatttacacttttttcacactgaaaataaaacagtaaaagccagcttatagttctttctaaatatcccaactttctcattattggatgcttctgcaaaacagcagtatggtgataccactcccagtgttgaccttgatgacctgagggtcccaaagtggcttcagcattatcatggagtcaccacaatgatcaggtagaagctggtgttaggaccagcgtgaatgggtcacaggggctgaggggggctgttgggaggtagcccatgccgtatactgaagagccatccatgccacttcaggtgggtgattgcagtggactctcttaccattgattaatcttcctaatattgagtaaagcattgattcttctcataagcatgaactgctggatgatgggaacatttctgtgattgtatcataagagaaagacaagtagaaagataattagaactgctgcaattctatgtatattttaatttaatttatttttttaaatacaaaagacagctatatttcctatataataaggaaacttattactttaaggaaatatactttctcacgagagaaactcaagattcaattcttttcacagttagccccgctgtggtgtgatttgatcttgggttccatagagatacagaaaatccaagtcccagtctgcttaattgccatgtttattttttaatctcggctgtagagcatttttaataactgatatgtagcttgcagggtagaaataacaatgctttggaatattacctgtgagactttaggaatgagctgaagacacccaacaatgacaacaatggcctctaccagcaaaacgggaaccatgactactttatcactcctgccggatctagttcttgtcagttcctgcaaaggctagtcacttgtctatttcgttggctagtgaaaaggaaatgcacaagaaatgtggaatgctgtctaacagacagaatcctcctttcacaagttgtttaagttggcagcccaagttagcaacctctatccgggtccttaacgtgacagcagaatgtgggtaggatggttaattaccagatgtgtctgttatgactcacccaaatcaatagctattaaatccttggtggctactgttttagaataggcttcattgaatatttgtatagaaatctgggtagaaaaatgtggacctcgaggtgatctaggtatttgttttgggcaaggaactctcatcagtggttggtttatttgtgtcttgggggatctcacatcatcagcctttattaatcacaggcacgaggggccccacactctcccccatacctctaccgccccattgctgaggatgggagagtaagaatatagaatatgctgtaggcttctgtgggattagatgcttggaggcagcggaggcaaatgttcatgggaacactgaatatggaggaagaggctgtgccagccccatagccacacatcccctccacccttacatcaggataagaggtagaccacagtctgttgacacttcaagctgaacattagttagtatccttctatgtgggccttcccaggtaaggatcgaggacactggttctcaacaccccggtgttctgggtcagggagaacagagaaaggagatatggaagtttcctgaaatgcatttcctctcattagcctcctgttggaaattctgatgccagcgttgtggggaatgggctgtagtttggaaagctccccaggtgtttctaatcccatgtgactttgtcttgtttttcccaccaccactggggtctcccaagttatggtttccatgtttgttatgtcgtcttccagctctgataccagagagtctgattctgtagccttggtgtatgcacgacctgtgaatttgcattattaacgcatgcctttgcctgttctgatccacatgaaccataattcacctttgcaaaacacacacttgcaaagaagctacccaaacagtagctaggaagttgatccagtaaagttccaagtacatctcgatgaactgttggagaactctgtattgggtagtaatttattgggaatgtctgtatacagggttaggtcttcactgaccaccataagaatttgggcatctttcgggataattggtgctggggtttagtaacaagaaagattctgagtagaggggtatgtagatcctgccagaggcactcccaatgtggatgctagcagcttacgaatcatctgtgtgtattaatatctatctctttgcaccattttttcttcctgttagcgtatttgatattcaggtttataaatgcttgtgctttgcttatggtcttgattccattgtatttctcacattggtcccttcttcgatagcagctggagtcccagcagagaagccctttgaaacctgcctgtaaccatgaagctccaggcaagagatccatagtgggaaaccatttgggtaactctactgaacaagcttaagagatgagctagaacgggctgagacagggcaggagagtggatctgtttgcagctagaggttttgctttgatgccgccttgggatgctgcacattcctttgtccagggcacaagctcattccagagccagatctgaagggctttgggtcatttgctctgttggatgttcttggctttcttttaggtaaataatcacaagttgactgtatttaccatacaaagtatatgtcattatcctaagttgtcagaaaaaagagagaagctggcatataagggcatatgtgcattttaaaccttgttacatatatgacaaaatagagggcagttattggtggcagattaattttttcaaaacatcgtgtccttgattttggcactaaaatagactcaaatgtgtgctggagagaggcctaaattcagaaccttaaaaatacctttttgtgtcctgagatcttattttagataatattaaaaataactttccctcctaggcatcttaaacaagtttgatgttataatcctttggtgattttattgtgattcactatagaaattacctttttgagtggccgttttgaaatttagctttagaaggaaatggtataaaagccattgtaggctgaataaatgtgaattctgcttactcatcactacaggaattagggtagactgtctctttacaataatagtttcctatactcatgttcctttaaaagggggtgggggcattatattaagaagtcacaagctctgacaggggaattgcagaagaagatttcagtttaaaatagctcacagttcctctctgatttggagttttcacaacctacatggtatagcacagactgttctcttttaaattttgtagtagagtaggtcaatcttttcccatctttctgccacggaaagggcataaatatttccatcatcagatttaataacctgtgttagactcatgagtaattgtaaatggtgaaacactttcttcataaaaaaaataaaaatgagagataatgtgactcagtattattattagaacaaatcaccttaacccatagaaaatatttctttcctgcagcaataagtgttgagtatttttccctggggtctctagcatctcttgataagagtgaatattgttaggtccagcctgactggtggccaaggcaggttaagtttatgcaatgagtcgattgtggtggagatacatttgcaagaaatggaggagcagtcggcatttcacctctctccatcttgttcacctttctctctccctctttagaaactgggagcaaatattagagcttacatgtgctcagtgagagtggagggagaaagctgtattttcctggggggtctggaggccttctctgggtttattcattttcaaagtcactggtggtttgctctctcctgggtaggtggaagacattgctgtgacctcttgcctgctcagggcacactgaagtctagaagcaagggttggagttctctgagcctgtgagtgtccctattcaaaggtgctcctggaagtgtctccctaaaggtctttgatggaggaggctggtatttaattatttttttctgaagtgcacaggcataggcattatgggttattgtaaagctctaaatagagccatgagaaataaggtaaatccatggaactgggcaactattattattattattattattattattattattattattattttattattattattattttggagacagagtctcactctgtcgcccaggctggagtgcagtggcgtgatctctgctcactgcaagctcagcctcccgggttcatgccgttctcctgcctcagcctggcgagtagctgggactacaggcacccgccaccatgcccggctaatttttgtatttttagtagagacggggtttcaccatgttagccaggatggtcttgatctcctgacctcgtgatccgcccgcctcggcctcccaaactgggcaactattattttaggctcattattttttggcaaatggaaataaaaagactcctcccctatttttatgacttggttacttttaaaagaagtatgcaccggacaagctgtgttcttcagtggttcttaacggagggcaattttgcacccacagaggacagtgagcaatgtctggagacatttttggttgtcacacatctggttgggggttgctactggcatctggaggggacactcactataagatgctcaacaccctgtaatgcacaggacagctccccacgacaaagaatgatccagttcaacatcttcattgtgccaaggttgagaacacagacttaaatagctcagagtctagttaccgtaacatcagtactgcgttttttccatggattttagagtggtcctggagagagaggaggaaggaaaatgtcatgaatctcagttgcaattcctttggctgctaaaaccatagctggtgatgcttgtcattgattaactttatttgctattttctttcttttcttatgaagaaagggaagccaaatctgtgttccctcttttgtcattaagaacatggatgctcagggtgttcctgggttcctccagccatttctccctcaagcaattatgctaattagtgtttgatcagatgattaaattataatgtgattaatcctgtgtgctaaccgctctgaatgcattttctctcgcctggttgccctgtgcctgaagcacccttttctgcggctggcggaggcctgtttttcctgtggatgtggatttctgttttcaaagcactgcaaattctctttgttgcctggtaaaagggagaggggatatttttgtaacctgttctctcaggcaaaggctggactggagagacctctgggaaatattgaaaccgtagctagaaagcactaatgatttgaagatactagatgtggagaaacgcttgaagaggagagtgcagagacagctgtagtggctccaaagtccatgaaatctttttctctgagagacttttcgctgtttgccttcctttcccttctgagtgttgcctaagtctctgcctcttgtgtatgtgatggccccgggaggggtgttctcggtttattttaggtttatatttccttaaaaaggcacgacatcatctggttttgttttctgataacacagtttaggtttgctcttgcatgccgtgtactttagactgggtgattttttgaggtgaggttcgttaacttaaaatgttgatgaaatgcttcctaatgtaagaaaattgggactgcataggaaagaatgtgagtagaaaatatcgatggtggtgttgtcattgatgggcttcttctctaaggctgcagattaccatggctcattgtgtagtttgatgagcttagcagtgattgaatttttccttgcaccctatcactttttctccctttatattagcttaatggggtagtctggatacaagaaataagagcatgtagaatatgtgcagttttttaaatcagaatttgcctgtgttttgatctggctggaaacgatagcctcttgcgttcaagagcaggtcacacgatgataccatatattaccattccagcttcccgcatcctaagaacccctgggccacaagaattactcatagagagagtaattatctgcatagattgtcacataccccttcgaatattgtgtaatctccttcatagaaatgaaaatctcttggtttgctttgaagaaagatatcctccttgtaattatttccctaaaaaagaatgagggtaaaaggaaactcgtatgtattgggcatctaaagtgtgtggacacttgagtgaccatttgattcgcactcgttatgtttattagctacaatagtaatgatcataaaaacaatagcttgaatttatgatttattactagatgtgaatattgttattatgaccatcgtaaagaaggcatggttagacaatgtgctcatggtcacacaattgttgaatgacagactgaggactacgcctctgttcattctcagtcaaatgggtatttttaatttcagttttacagattgcaaaaccagggtttggaaatgttgactatcaggccctggtcaggtggcaactgtgatttgagaatagcactttgagcccaggttgtctggtgtcacagtctttaaatcttctcccaaatcaagccacattcattcatttgaagttttcaagctgaaaatgattatgttaaattttctttaaagagttgttttgggaaagtgaaagatcggtttttaaaaatcggtgtataaatggaaaattcatttacttttccatgtcagccatttcgcttacttaagttagataagtaagagacaggttaattaactcttacccacttcagaggtgcaactatttcatgagattgcattctgttgggaagagtaaaattggagaccagatgacagttatattacattcatattacaggatagaatctttccccaactctcaaatttaaatcatgcatctgtttttaagtacactctatttcatttgtcctgaactgactaccaattttctcaatgccaaaatatcagaatcaaaatatttttgaaattgctaattggaggctgaaattgtgagttttgtatcagtttgagcttttctgaaaaaacacccaaattagttttgttagtaagcgtctgaatcttattgaagctgaatcattttaccggaagtgtccatgggacatgcgtcttaaagagtttagaaaatactgcctagacatttcagcctgactgaaagctcttgtaataaataagaataagctatgcctgtgtgtgcctgtgtgtgtgtgcatacctgtgccacgctatggtgatattcttattactctctcacactgagttaaggttcaagccagctactcatatgtgatatatgtcttctgagaaaggacatttgccttctgtggagtgtgtccattgtccaaatgtgatgaaaatagaccagttctctcagagctcagagcttccctcggctgctggctgcaaggtggtggaactcggtttattgcctggttggcccctctgcaggatacacactgcgtggtgctggttggaatactgttctaatgaagtcaccatctgggtccactggttggtcccctgtcgtgacaattgccttcatcctgtccaatcagccacctcacaaaccttggccagggatcccatggagagtctgactacagagaaatttaaagatatttgtcttcttgtctgtggcctaagcagcctgaatttcatactatggtaatactgacagaatcacctgtttatggagtggtgaatgaacctgtttatagtaattgctaatattcattgagctcttattgtgtgccagaaactgtgctaagtgcttttttctaccatcccatttaattgacaaacaagtctttgaggtgcctgttggtattatttccactttacacttgcggaaattcaagacttacaaaggtgaatgcctttcctagagaaggcatacattgagccggggtggaagcaggatttgaacccgggcagtctaattccagaactcctgcacttgacttccaggctgtcttcctggatgaatgagccccagataggtcagctggtttctgagtgcacatactatttagagtggtgatatagcttggatatttttccctgcccaaatctcatgtccagttgtaattcccagtgctggaggtggggcctggtgggagacgtttggatcacggcttggcgccatccattaggagggatccttcatggcgtggcgctgtgcttcatgatagggagttctcttaagatctggtcatctaaaagtgtgtggcacctcccccacctactccctgtctctcttgttcctgctttcaccctatgacctgcctactcccctctcaccttccttcatgagtgtaagcttcttgaggctttcttagaagctgagtagatgccagcaccaggcttcctgtaaagcctgcagaactgtgagccaatgaaaccgcctttctttataaattacccagtctctggtatttctttatagcaatgcaagaatgacctaacacaaatggccatgcttatctggaaaactggaaatgtaagttatggggagagttaagaggagccagatagcaaacatggctttcttaagcttttctgaaggaagatgtgggaaaaaatgtggcaatatgagaacaatttgggagtctcagggttggtttgttttcatcccagcatttctggaatctcagctcattcctgagatgagaggctcagtcacgaaaacattgccaagcacttgtggcctctcccatgcaactaagcacctggtcatccccacttcccaacgtgcagcatgtgtcacccatcttttcatatccatttctatggtatttggattaaaaattaaaccctccaaatttcagcagacaacactaggtgaccaccacctgtctgtagtgatctcgataccatcacggatctatctcttgacagctgactccaacgccaacttgcttttcctctgacctgtttcaccaggtgctcacacctactcacccatgtctcagagactatagactttgtgatatacctgattatacagccccagcctatctgccattgcatcagagcagctgcacttgaccaaggagctctcgctgcacacactgtgctctgactggtctcattatgcatgaccacaaacctcgagtgggctcttagctctgccctcaatctacctcactgccctagttgatttctgtgtctgtgggaagactacttcacacctttctcacctccccaaacctcaaactccccttcctttcccagactctgagtcgataacctcatatgatttactgagaaaaccgaagaatcaagtgaatacttggactattccctgctctccaatacacacccacacactcaatttttcatgtgatcagcgtccactcctgtttttattgcctccctttcaccccactgatgatgggggattcagttataggggtggttgaacacatgaccctgggcagataaaattgacagcagtgttgcattcaagtattcccacagcccaggggagtaggacagggcaggccatacagagtgaactagcaggggctgcgggaagcagaccttgtagtaacaagaagggatggtggccgtgtgtgcacacctgtaatcccagcacttcaggaggccgaggcgggtggatcacctgaggtcaggagtttgagaccagcctggccaacatggtgaaaccccatctatactaaaaaactacaaaaattagctaggtgtggtggcatgtgcctgtagtcccagctacttgggaggctgaggctggagaatcacttgagctcagaaggcggaggttgcagtgagctgagattgtgccactgcaccccagcctgggtgacagagtgagactgtctcaaaaaaaaaaaaaaaaagagggtggggtgtcccctggttcctgagggaggatgtgattggcttatttggctgattccacaggctgacgggagaccgaagcccactactcatgggtaagcaggcactgtgcctggtccctatgagcggagtgccatttggctaggggactttatccatgacagctcatgggtgggggagaactagcaggtaagccctttgaggctcttctgaatttatcccgttcacagcaacacaatatggaaccttaatctcaggtcccacaccagacccatacacatgaccttcgctactgtgaccatggaagccctggccttgctcctgttgaaagctgaaacctccattcatgtccagaattccacatctcccatctgcttaaagactttgcccttgtatttatttttatttatttatttttatagaaacagggtctcactatgttgcctgggctggtcttgaactcctgggctcaaacagtccccccgcctcagcctcccaaagtgctgcaaatacaggtgtgagccactgcatcagtcctgcccttgcattttatctcagcctcaacttccccctcttccagctcagcatatcaacattctgttttctctctgttatccctaccactgtaaaacgtactaacaaccaccacctcccatcttgtcaccacttccttcttccatccaattcctctgatactttttaatagtaaaactactggaaagaattgagtatactagtgcttctcaaactaactgtgctgaaagatcagtttttcattttccaatctgttgcagcttgatgtgaggtccttacagtacttgcctcaaacacagcttgttgctcatgcttcttatcacatgagttgaacgatacacaaagttgcctgtaccgcccttcctgagaatggagcccactgatcacccccttgaatgttgcagcaacttctcagtttctgtgcttgtctcactgtagacaagaaacaagcagctggtctgtacacacttcgattagcgctgtttcaactcacctgacactctcatctttcagtctctgttgaacacacactgatcaggtcttcttcaccactccattgaatctgcttttgtcaatgaggctgatgacttccacatttctagtcttctttttctgtttattttctttctttcttttcttttttttttttttttttgagacatggactgactctgtggcctaggctggcatgcagtggcacaatcacagttcaccatggcctcaaactcctgggctcgagtgatcctcccacctcagcctcctgagtagctggactacaggtgctgcaccaccacgtccagctaatttttaatttttttgcagagatgggggtctctttatgtgctaagattgcaggcatgagccaccacacatgggccacgtttctagatttcctcatgttcactctctcagcagctgtgacacaacagatcacacttcccttcctgaaacaccttcacctggaccgtgcacacctcactctctgggtttccctctgcctcactggcttctccttctcagtgtctttggtgagcttcttccctctaattagactctaaatgttgcagcccactccagggattaattcttacccctctcttctcctctcctttcctctctgcttcctttcccttcccttcctctctctaattcctctctatataatttaatttaggtcaaggcattaaatgccctctctatgctgatgacttccatattcgtatctctatccatgatttcttctctgagctcaaatccagatcctgaaatccagctgcctactcaacatccctttacaaaactcacaggtatctcaacatttaaactctctgaaggaggccttctggattttcctccctgtaaccacttctatctcacattttggtcattcaaactgagcatcgctcgtccctcactgcacagaacagaaatctcagagtcgtccttgattcctctctgtccttcacatcttgtattcaaaccaccagcatgtcctagtgatgctactttaagaatctgaccatttcttctacctttaaattccttcaagctgcgttctcctttttgcctggactatcatgataatctgccaactcacagctgaatttccacccagtagccaagggatttcctcaaaatataaagcagattacatcactcctctttccaaagcctctcccttcatccccaaaataaacacagcattgcctacacctcaaaccccttccatggcctggcttgggctggcccaccccaccccctccacagagccatgctggccacctggatgtttctacagcttgctgagctggtcctctcctcagcactgcactggccgcgtgttctgcctggaatgctctaccctggccttttcccgccccacttcttcacttctttcagttctctgtccaaatatcaccacctaagagaggtctccctgaccacctgatctaaaacaaagtggcctccttgattgttcagtttctccttgccatgcttcaggtttctttgtggaagtcagagtacttaaaatcatatacttagaagtttatcatctgtctctcccaactggggaagcccacatttgtctactgtgctcacctagaagagtgactaacaggctgcaggtgcccagtaagtagttactgattgaataattaaaccaatgaatgttgtttaaagcaatgtatagctcttagggactggatgtcattgctgtctcttcagttctactttatttatttatatttctgatggaatgacagtatatctctgtgtgacaatagtttctgcatttggaagatctgcacttgtattttaattaaaagatcaacaagcattatgccctagaattctcaactctcacgcacccataaaagatataacaataaaaccccttacttaaaaaaaaaatctttgttgactacccatgtaatttctgatatgttgtatatactttgaggaatacaaagatatttggttcaaaaatttttgaaaatgtttactgaggccaggcacggtggctcatgcctgtaacccagcattttgggaggctgaggtgggcagattgcctaaggtggggagttcaagaccagcctggccagcatggtgaaaccccgtctctactaaaaatacaaaaattagccgggcgtggtggtaagtgcctgtaattccagctactcgggaagctgaggcaggagaatcacttgaacccgggaggcagaggttgcagtgagctgagatcgtgccattgcactccagcctgggcaacagagcgagactccatctcagaaagaaaggaagaaaaaaaggaaggaaggaaggaaggaaggaaggaaggaaggaaggaaggaaggaaagaaagaaaatgttcactgaacacctatatgcactaaactgtaacatccaagaaagcagggattttgtgttgcccattgtagtatcttcagttcttagaacaaggactgacacgtaagttgctccctccatatttgttgaataaataaatgagaaaaaaacactatattaacgactgtgcaagaaacaaaacaacttcctcttttctgggtcatggcaaagtctccaggacaataggacatgctcacagcttctaaaagggtgtacccaataatgaccaccatgtcggacatacagagaaagctctgcagtgtttatggaagcagaaaacaacttctgattagcctatttaaaaagggcttcaaagagagggggatttaaaaactttacttttaaggttgtgtatgcttttgactgggaaacgtgggcagtgaaaagattggcaggagaaaagaggaaaatgagggaagtccccgggtgtggagggagagacacagaattctatcaagctgctgtgcaaagtcatggtggaagacacatctaaaaatgggataggggccgggcgaggtggtgcctgtaatcccagcactttgacggggccaaggcaggaagattgcttgagcccaggagtttgaaaccagcctggaaaacgtggtgagacccaatctctacaaaaatattttttaaaaagtaagctggggatggtggcctgcgcttgtggtcccagctactgaggaggctgaggtgggagaattgcttgagcctggaaggttgaggttgcagaaaaccatgtttgtgccactgcactccagcctgggtgacagaagtgaggccagcttctgtctccaaaaaaaaaaaaaaaaatcaataataaaaatgggatagggagcagattgtggaaagatttgaattcaaatttagatggaattgaattgaagattcgtgtgttaaaatgctcatctctatttgagcaatcaatgcagtattttggttgccgcacataagagacattggagagcagagagaattggtggaagggtggccaagcaaaggctaattccacggtgccggggtgagatgatctgccactaggacagtgatggcggctgggtactgacctaggtgggaggctgggggacagagggagcccaatggggatgatccaagcatgactgctgataaggttgggtctagattatccccatggcggtgtctcacaatgtgagtttaccgttaaactaaagctgtggatagattttatagccttgtgtgtttaattactgccaatattgcctactttttttttttcttttgagactctgtgaaatttgcgtttctgcaaactatgtgccagaatggagtcattgacagggattttataacacctgatgagaattattctataattttatcacagcataacccaagagatgctgaaacctgactgcattgcaatatgtatggatcagagggcacatcctgaagggctaatcagcttcaatcaactcataactgacaagtttaatttcttctgttttttgtatttctcttgaaattaaagtatacaaaaatgtagtattgacagtgaatttgggtgaggtttcactgtagcaatcaccatctattattttacaaatcattgggatcaattttggttcctgttagcataaagctatttgggtttttagtaaccagaaaatgaagggttaagcacacctataaatatttatattttttgttatgtagtataacttggtatcacccaaatatccattttccctcattcatatcctgaaaaattttaagtttaaaaatgtgttccacgttgtgagttttgaaagccttaaacaagttgaattgagatttacaggattcaacttagtgtaactttgacctcaaaataatttacaattcatttcatatttcacatctgcagcctcactttttcgttgagcagcttaatggtttttttttatggtttatctgtttttggcctccttgtctgtcttcctttctctcctcatcttgcacacttattgacacacacacacacacacacacacaatgtatgtatgctaagattaagcattctttcttttttgggggggcggtgctggggggctggtgtctcgctttgtcaccctggctggagtgcagtggcacaatttcggctcacggcaacttctgcctcccgggttcaagcaattctcctgtctcagcctcccaagccgctggaattacaagcatgaaccaccaagcccggctaatttttgtatttttagtagagacggggtttcgccatgtgggtcaagctggtctccaactcttgacctcaagtgatccgcccgcctcggcctcccaaagtgctgagattgcaggcatgagccactgagccaggccgaagtgttatttcttataagaagtttatgtgtaaattctttgcttttgtacttattgaaaaagttatagttttgtacttattgaaaaactgaaaataaagagaagtagggtttacatattgtatatacccatctcaacgtgatacagattgtgaggaactggcactatctaagcagggtgatcatgatacagaatgttactaatgttattaatgaccgaagatgaaaccagtgtaaactcaccaatgggctttcttagaaggagagcattcattaacctgaaaatatttactgtgcttattttatgtccattgggaatatggaataagataagcacagtataaatatggtttcttagttggccatttcattaggaaattatgacatagataagtacaaagtaacaaagtctttttttttaaaaaaaaacagaggtaatataagctaataaaacaaggagacaaactgaataatccaatttagttagattataaaatgagctcctgatcattctaaaaagacttttttttttttttttttttttttttttgagaaaagatctcactctgtcacccaggctggagtgcagtggtgcaatcttggctcgctgcaacccctgcttcccgggttcaagtgattctcccacctcagcctcccgagtagctgggactacaggcatgttctaccatgcccagctaatttttgtacttttagtagagacggggtttcaccatgttggccaggctggtctcaaactcccgacctcaagtgatctgcctgcctcagcctcccaaagtgctgggattacaggcatgagccactgtgcccggtctttttttttttttttaacttttattttaagttcggggatacatgcgcagatttgttacatggataaacttgtgtcatggaggtttgttgtacagattatttcatcatccaggtattaagcctagtacacgttagttatttttcctgatcctctccctcctcccactttccacccttcaataggccccagtgtgtgttgttcctctctatgtgcccatgtgttctcatcatttagctcccatttataagtgatgacacgtagtaggtatttggttttctgttcctgcactagtttgctaaggataatggcctccagctccaaagacatggaaccaacctaaatgcccaccaataatagacaagataaagaaaaatgtggtatatatataccacggaatactatgcagccataaaaaggaacaagatcatatccttttcagggacatggatgcagctaaaaatgttaaatataaacatagaggagaaaggaagctttgtgaactgtacttcgggagggctttatggaagtgaagctgttgccacagaatcctagggaacatggatcagtgctgtcctgcagtttgagaagagggctaggcattgaaagcactgctgtggggtgtgtgtgtgtgtgtgtgtgtgtgcgcgcgtgtgtctgtgtgtgtgcatgcatgcacataaatctagagactgaatggatctgaaggaggctgaagagcaaaatccaggctgcagtgagaagcttttaaggactctcagagcaaagctgtgtgcaacagagctaaaagataaaatgaaaaatgtactgactcttaagttgtgaaaagtcaaaaaagacaatttgacaaactcaaaacagtgaagatgattcaagaaattagagtgtgtatatatatatatgtgaagatatatatatctatatatatgtgaagatatatatatctctctatatatgtgaagatctatatgtgaagatatatatatctatatatatgtgaagatatatatatatctgcgaagccctccccaactacagttcatacatatatatatatgtctggatatctggtttgggtacaaaaaacttgctgtactaaattattgataatatattttaaggcaatttactaagttaaaagcataataaattataatctattattgtgctctagagaagttattgcttaatgaggaaattaaggttaacattgaaacctgggaggttctgatgtttaagtgggcataaatcttgaatggagttaggctcagggccacactgggtgatttatccaaattcactcactcttgattttttgtttttttctttgaatttttacatggctatggagttcaaccataagataatttttttctgtaatacatatttatgaccctaatttaaaaaaattttattttactttcagttctgggatacctgtgcagaatgtgcaggtttgttacagaggtatacatgtgccatggtggtttgctgcacttatcaacctgtcatctaggttgtaagccccatatgcattaggtatttgtcctaatgctctcccccaccttgcccccactccctgacaggccctggtgtgtgacgttcccctccttgtgtccatgtgttctcattgttcaacttccacttacgagtgagaacatgcagtgtttggttttctgttcctgggttagtttgctgagagtgatggcttccagcttcatccatgtccctgcaaaggacatgatctcattcttttttatggctgcatagtattccatggtatatctgtgccacattttctttatctagtttatcattgatgggcatttgggttgtttccaagtctttgctattatatatagtgctgtaataaacatatgtgtgcatgtgtctttatagtagaatgatttataaccctctgggtatataccccgtaatgggattgctgggcatgaccccaattttttacctaagagctttttatagttctagctttttttagtcacaagcagggggcctttatttatatatccctacacacattatttttctccataaattgtcaacttcctgccttatcccattcctgatgatgatatcctgttcttgggaattaaggccctagagccctagaaccatcaacagttagacatggaaggacctttgttaattacctgtcaaaatcttctatttgaaagataagaggggagtgaggatcaaagatgtaaattgacttctttaatgaggcacaatatgagtggaatggagctggaacccaaaccaagctggcctatctcccagctctagacagtttccatcatggcaaacatattcatgagaagaatgttggaagaaattagaaattcgcatataagccaatgcagatcaatatatccatgctagattgcgtgatttatcacaacagcttggcccacaatgatctcgttggttgactgagatgggccttttttacactcaaaatttgtgaggattagtaattatatggcattagcattatgttcctaaatttatggctcagtgaatgctaagtatgcaattgggaacgtatacacaaccattatgtgtttggcccttgttgtttcctgagactcaacatcttatagggtgaaaatccaataatgtgttttgacgacatagactgcccccactgtctggggaaggttcacatggggctgaaaagctcccctgcctgggtgcagcccagcacagtgctgtggtttgaggcaatctgtgttcaattacggtaaaatgttaaattagctgaaagagaatttttctggtcacttgagtctgccttttggactccattaatcattcaatcattaaatcatttatattaaccctttctaaccagtcctaaaataatcagctttgtgttccgtgtttttcctcagttagattttcttgggcaaatagccctgggccccagtgaagaatccagcctaccttaggtgctcagtcagtgttgagcaaatgggtggatggctgttacgcaaatgggctccgtgtagggcttattagacctcaaatcctggtttcctgtcatacttcaacaggaaatgctacatttgtacttcagatctaaattttattttaaagccagaaaaagctctttttatataaaataattatgtggttattttaaagtaacaatgtctcattccaaagaccatctctttccttttttggttcagctgtgttttagacattatctaaatttagtcgttctcttagattttatcacatcttcaaaaaatgctattttagagtaaagaatatttttaattgttctgttcttaacctcagtgtccatggagggttggagaagaagcaacatatatgaagctgaagattgatttctaaaccttcagttaacgttggctttccaagagcaaatgctcaagcgtgggataactatcttatgtgactttgtctttttttttttttttttttttttttttttttttttttgtgagacggagtctggctgtgtagcccaggctggagtgcagtggtgcgatcttggctcactgcaagctccacctcccgggttcaggccattctcctgcctcagcctcctgggtagctgggactacaggcgcccgccaccacacccagctaattttttgtatttttagtacacatggggtttcaccatgttagccaggatggtctcattctcctgacctcgtgatccacccgcctcggcctcccaaagtgctgggattacaggcgtgagccactgcacccggccgactttgtcttttttttaaaaagaaaacaacacatcgcatgggggcggggtgcctccatccaggcagtgttgcagggacaggcggatgtccctttaccacatcgaggcccaaggagctttcatcaccgggagcttcttttttttttttttttttttttttttgagacggagtctcgctctgtcgcccaggccggactgcggactgcagtggcgcaatctcggctcactgcaagctccgcctcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaccgggagcttcttgaagtgatgaaccacgcagtgttatattccttttaccttctactctgtcatataaatgatgacaaattgcctagctgtaaatttgaaagtccctaaatggcatttttgtcaaagccttgagaacaaaatgcttactcggagagatttttaagtcttgggagacggggtggcggggagcaggcctaattattatgcatcatggcacaatgcattatgcatcacgcttgcttttctgctttttaaacacttgttatggatgatgaaactaatttaaatggacaaacagggcgctctcctgcacattactcctgtgatgtcatattcttcttccaggggatttcatcctgcttcccttggaagtcccccagacatgcacattttaataagacactttaataattagcttagagataattgtcagtcaagggaaaataaccttttatcataggtgccttgaaagtggcctgttccagagaagaaacaagcgatctgatttgcacttaagcttgcttccctttccctcctggcatttatgtggaataaaatactacaaacgggggagagtgtaaaaaaaggaaaagtgtgggtgtggaaggggaagccggagctgtcaaattgttaagacaaatggggcttagagaatcctaattaaacctgaaattgcttagaaacaggaagtatgtattcctaattgttggcaccaaaaaaaaaaaagaatctaatttactgcatatctttaaataagaataacccattatttggctgaatgagaattcaatccttacctattgaagaggtgaatggcgtgattttaaaggctatgaaattcacctccaaagttcatcatcagctttagagaatgtcaaaaaagagcgagctcgaagccatgtgtagaattttttttttctttttctcataggtgtattctagctttattttggggaaactttagtctattgagacctttagaaatattatttgggtctctaaaaaataaatatgggcatatagtctcaagactcaacagaaaatagattcattttgaagacaacccagcagcgttgcttaataagaaaaaaaatgtatccccttgggctaggacttcagttcctgggaggatgtgaaagatctctattgcagatcgcagcaccagtctttcctcctgttattgtatcttttgatgcagaggatcaaccacccctggtttttgttgttgtttttattgagacagagtctcgctcttgttgcccaggctggagtgcagtggtgcaatctcggctcgctggaagctctgcctcctgagttcaagcaattctgcctcagcctcccgagtaggtgggactacaggtgcatgccaccacacctggctaatttttgtatttttagtagagatggggtgtcaccatattggccaggctggtctcgaactcctgacctcgtgatcagcctgctttggcctcccaaggtcaccccctctttttatttgggggtaggaagggcatctagcatcccgacacctcaaattcatcatcacatggtgcaggacagaactaaggacaaattaggaccctttctgagcctttgctcaagcttcaaatcacacttcttctcgtttgtacagcacttatagcactttgactttcatttatttaaaaaacacattgaatatgttatccccactttttagaaactgattttgctgttttgacattgtttctctagtagacgggaagggataatagattggaagcaggaactgtggattctgcctgtggttgcctctctgactttgggatctcagggatgtcagccacattgcctcatctgtggtgacaaccacaatggtgacaggtggaatcatgatggctgcaaactactgagcactttctaaatgccaggcactgtgtaggatctttcatcatcacatctcagtctcactgtagtcctctctcccctttacagatgagcaaactgaatcacagaaaggttgagaacattgctgaaggtcactagaggtgtgtgttcagtttgaatgcagatcacctgacttcaggaacagtatgataacctaaatccctaaactcatatctcccatcctgtctacctcacaaaattatcgtaaacaacaaagcaaacggccataacttaggaaaaatactttgaaaacaaggaagcacaccctgggtgtgtgtgacacttccattattatcactttctcagcatttcatctggaaaacggacgtaatcacagttgccctagaagacagtggtgctcattacatggaagagatttgattagtggtggaaaattttgtcttttaatttgtccagcagagggttggtgccagctttatcctgggagacaaagggacctacatttgcttatatttgctgactaggttcttgtgtctgtgtgaggggcagcctgcctttaaggcattatctgtgtcagcccaggttgagggcttagggatggaggctgctggtggaaacaaatgagctttgtttagggggaaaatagccttatctcgtggcagtctgtcccttcctatttgttctgagaaaatgaccaagtgataggcccttcatcatgtacaaacactctttagattggggttaccttttttctttgggaactggaactaacaaaatggcaatgacctgaaggttgagaatgacttctcctctccattcagcccctaccctgtcagctgtcactgcctgcatcactgggctgcagcatttcagcatcttctttctgaagcagatcaaatcatgcttagaaaatttgatgtgtggcccttctcaagggcttttcttcacttgtttttattttgaacttgtaaattgctatcacattttcaaacactgcaatcacctcgctaattgctgtttttcatgaataagaatacaagatcaatggccttttcaatattttcctttaccgtgaggtaatcgaaggtcagtacataaagctcctgacatttcagttacctgctcttcctcctgttaactggattacctacttgcctcttgtggttggtcccagtgtttttatttctgcctctgcaattgtcagggtgtggttccaagtcaatcacatctgcaggtcaacgtctcatcttcgttttccattatatccttttcccgctcttcttcatgattaactaaaaccccttgacaacaatgatctatgtatttgtcaatgttgctgctaagcctttagcatcaccacggtagagacagacagctcccttcctcatcaatccttgtgtttatgtgagcatttaaaatagctattagatgtaacttagaaagaagcagtatttcttttgtcacagcacatcttttcaagagagattttgcacttctcactttggtcctttctctactacgctaaggtgtgggacttcacacagattgttcttacatttttaatgaacaacaatagtaagcaattaagaattttagcttgagattaaatattgaaaaatgtcactaaaagagttacaaaaagtgcaactggacctgtgcagagccagagagtctgcatggttctgcggttcttcatgcgcaggagaattacacagttggcacatcccagcccatgctggaggccacaaataaagctgttgtttagtatgctccagttgcattttggtcacatgtgcttatattaatgcctttgctttctgcttcctcttgggtattatgtggttgcttggctgcaacagtgaattccagctgcattgatgaccactggaaaactgcaagagaccaaaagattcagggaatcgagcctgcctcatacccctcataaagctggaaattaactccaaaagaaaccgtcaaaactggctgtgctcaggggctcatacctgtaatcccagcactttgagaggccgaggtgggtggatcactaggtcaggagttcaagaccagcctggccaaggtggtgaaaccctgtctctactaaaaatacaaaaattagccgggtgtggtggcgggaacctgtaatcccagctactcgggaggctgaggcagagaattgcttgaactggggaggcagaggttgcagtaagctgagattgcgccactgcactccagcctgggtgacagagcgagactccatctcaaccaaaaaaaaaaaaaaaacaagaaagaaagaaagaaatcctcaaaactatacaaatatatggaaatcaaataatctgctcttgaataatcattaggttaacaatgaaatcaagacggaaatttaaaaattctttgaactgaatgataatagtgacacaacttgccaaaaccactgagatacagcaaaagcagtgctaagagggaagttcacagcattaaatattaaatgctgacatcccaaagcctgaaagtgccaaatagacaatctaatgtcagacctcaaggaactagagaaacaagaacaaatcaaacccaaataatacccctgtcttcatataccacagttatttagattaatcaacatatgtgtggtctcataggttctcttgcccaaccatggtttttaggtcagagagatgtgggttcaaatccaatcaactcttccctagccttttatggaatgaaatggtgtttcatttgtgccgttatcaatcatcatctctattatactctttaggatatattaggctgcacttttatgcgcatgagctttttgtatttctcctcgtatttcaaagccagagttctctgaagacatgtcgaaacccatttacttatctccctgcctatactcactcaacacctggtgaatttccatctgccattcctttcactaaaacaatttaccccaagatcaccagtgacatacgtattgttgaatttagcaggcaattttcaatcctcacagcagtttccaacactggtgaccacaatctctttactgaaacaatctcttgctttggcttccaacttcccactttctccctccttcttttatttttctagtctctgtatcaactgggttgtgcgtgacctttaagtgaattccttaaagttcaaaccaaggctctcctctatctttattctacatcatcttctagaatgataaatgtgtgcccataactttctatttcctactgtactttgagcttcagacctatatgttcaattgtctggacatatccacttcgaactctcaaggtttcttctaaagctagtaatcctaaccaagttccatcttctccctctgtggcccacaaatagccataccgtgagagtgtgggtagtcatggttcacatgtatccaaaaagagagcacaggtaatggaagggaatttaggtgtcttgggagccatggtgtgatttcttgatgagagctgtggctcaggggtcactgtctgcgtgctgggcacagtgtgacagtagaatgcatggactcccaagctgaagatataagtgctgggttatctaggaagacttccttcagacactggtgtgatggtgctgtcattgacctgagtacctgctgcatggaaggggagaacatattcttgctaagactgggtatttgagatgtggcagtttatgaggtcagatggtaacgatttctggctctcagttgatttgctatatttttctgattcaattctgtttctctggttatatctgttatattcctgctctcccttacctgtttcctcacatctaaagaatacttcactcttcacttactcactggtattttccctgtaaacctctatgccttctcctgatctattgtttatctccttgtaagctaactcttctactctccaataccaggaagatgggagatgaagaagaaatattctctttttgctgaagcaaggatgcctcaattggagaacatagtgagagtgaatcacaacctaaaggcactaagaagtgagaaaggccggaacagacaccaaagttgacttccagtggtcccaggtgcctatcccatatgggaccccataggtcttcaacgcaatctactcagcctggctcagcccacagagaggttctgtgggagataaagatttctcaaaaaaccaaaatgagaaagaaaggctaggcctggaaagtgacccaaagctgagttaactgctctctcagcctccaggttacccatgaggatttctcctttctgtctgcatcagcctttgttctgtctttgcagactgcctttatctgcttctccagcatggaccacctggttctgctgctccagggcccccttcccaatttctggtggaaagaatctgactccacgtgcgcccattgatgggtgaacgttaaaactctttagaacacactttcttttccagaattcatgttgatgaacttgtaagaataattaaatcaattaaaattcaacaagcatcaagtatttggtaggttatcaggtacttgactgagtcaattcaggatttaatctcaacaggtaaaagcttaaaaaggaagcaatcatttgaattaatgtttgaaatgcagagccacaaatactaatttgggggttctggctaatatataacaccctcgaaaagtctgtttgtatttaaatatcacatggaggctctgtttcttgctccttgactctgcacgctgtagcatgaaagtgatgacattggactctctgtcttctctggcagaagcccactggaaaggatgtgagaaaccctgactagggacacactgagccttcccatattatttaatgacagtctgtgccagggcctccattaatttaactgaatgaaatattcctatctggggtttcaatagcccttcactgagtatctcctatacaatgtccccatcatggtgtagcctctcattgcaaacatacaatgaccccaagtgaaaaaattatttttataactatagcattttttttagagacagggtcttgctctgttccccaggctggagtacagtggcactatcatggttcattgcagccttgaactccaaggctcaagcaatcctccatcctcagcctcctgagtagctgggagtacagtcacacaccaccatgtctggatagttttttaatttttattttgtagagatagggtcttgctatgtttcccagactggtcttgagctctcaggctcaagcaatcttcctgccttagcctcttgggtagctgggactacaggcatgtgccaccacatccagctacaaaaattttcattattacctcagctggacaagcgagaaaactgaaatccagggaggttggagctgggtcagctaattagtgatggggccaggatccaaacccagatctctctgactcaaaagcttaaacactctacccaaccttcttgtgttcctggtttaccagactacccaccaggaacagactcgggacctactgggttaaggagaacttctaataaattcatctctttttacatgacttctctcccccttttcagcaaatttctggagtagaaacaatttacattcttctaagataattttcttccccctgaagattaccacacactccttcctgtgcacagacctgagggtgcaacgttctagctcctcaggaacttctgagagggtgaatcgcagatttggatcagggtgaaggctatgtttgatcaatgttgttccacaaggagatgcacagtaacatttagactacaaggaaaagcagctccagccctcttctttgtctgcaagttcagccacatgggctgtaatctcatagtttcaacagaggggcctgctgcctctggccttactgggcagcaggtggtggggacggctgttccttctggagcgacactgccatctcgcctgaagtcaggaggcaatggtgcaatgcactgctaatatttttctcctgaagactgatgacttgctggatctgtagctaaatgtcttgtctcattttcacagccacgtcatcgcccttttcctagtgcttgtgagtgagtcacgtgcaagggccatctgggaggaagcgttctgttaaacctttctttaaagcatctttttgatgtcctgggaaatgcacctgcccactagagttcaattcagcaaataattgttaaatgatcaccataggcaggggacttgctatgaatataacaaagatgaaaatgccagttgacagaagcatgacgtctcctagaggacccagatccaagtgaagcaagtgcagtccaaggcagggcagggtctaggctgacagtttacaaggctcagtttcttagccacttacctacttctgaaatgcattcttatatgtttaacatctttattgagcgataatttacataacgtaggattcacttattttaactgtatgattctctgattcttaacaagttcacagagttgtacaacaatcgcccttttagaactacccccaaaatatctctcatgcctatttgaagtcacttcccatccctgctttgaagtcccacccccagtcaacagcttctgtctactttctttatagatcggcttttcctcaaattaggatctgcttctggagaactcacaccaagacacggccccttgtccagtcttatgagctaccagtctgtcctgggacatggtggcagctgttgtctcttgcctttatcgtggtggtggctgtgctgacctggggaaccctggaacttctgctatcaatcccaacaggccagagctaggtggatgctctggtctcatctcattggatgagacccctgtcctgccctaacagtcaggacaagggtctaatccaatgaagaggggcatcaaagattgttcaagaacaatcagattgaccatgggaatgggtcagtggtgagcatgtaggatagtctctggggtagaagttagatgctaggcgcaggttaaggagcctggagctgatggtccaggagggttatgtcacctaacaaagcagagagtgtcagctcatctgcaaatggcgtttgcctttggggtaattccagcccacactgaatagcaggtccatgtgtaatctccaaagtcttcttcaactttatgagaatgggcctgggcatggtggcacatgcctgtaatcacagcactttaggagggcaaggtgggaggattgtttgaacccagagtttgagacctgcctgagcagcatggtgaaatcctgtctctacaaaaagtgaaaaaaattaggtaggtatggtggtggtgcacctgtagtctcagcaactggggaggctgaagcaagaggaacacttgagcccaggagattgaggctgcagtgtgctgtgatcatgccactgcactgcagcctgggtcacagagagagactatgtctcaaaaaaaaaaaaaaaaatgatggttgtattaacccaaggcctacttagaatctcaaagacctttctctctctcctcatctcctgccagagcttgaccactctgtggttctagctgcacttttatcacttctctgttctacttgcaagatggcttcttttcatttttttgtgaactttgggtctgtatgttgtcagcaatcttcagtgggcatttttgggcctcttggtcttcttgtggtctggtgagtagagatgttgactgatacaaggacagtggaattcccccattgcttcaataattttaatagctgaccctttgaggaacattgaagctggatggtcattcagacttgtcccaaattgagttgggctccagcaacacccattgaccagtcattggatgagtgatgtctttggggaggaggcgtctttggttgaggtcatagaaggactcagctctgaattctttgcaaacaacacactcagcagatgaggagatgtgtacttaggcccagaagtaggaatctggacagcagaccacagtttctactatagacaacaaaagccacacagtgaacatggagctaaaagtcactgtggttcatgaactataatatacctcacaatagcatgctataatatgtaaaaatacccctcggacagataagagaagaaggtggatagaaattcaggcttttggcccttttcaccacttcccaaccctcttccctttttctctcttctcttgtctcctgccagagcttgaccactctctggttctaactgcacttttattacttctctgtcccacttgaaagatggcttctttttattttgttatgacctttgggtctttatattgtcagttgctataaatgaataaaggctttttccttcttagtgtgttggtgaagaactaggagtattgcactcactgatcaggagggaacaggtctagggagtgcatagaagctttccaagaggagtggacaggaagcctgtcctccccctcgccctccacccccatcccgccccacctcctgcgaaggcaggaggaccatgaacctgcaatttggctgatggcagttaaggggtaatcaaaagtccaggcataggaactggttccttagtgtccatccaaagcctcaagaggctgacctggaaggatgcaggtgtgagaagccatgtgtggatcccaagtttaaggacatagatgttttccttacagaaatggaatttggacactatatggttacgtggtcagccagcaacagagttcaataataataaacccctaataaaatatttatgtttttccttatattacgtttctcctatgaaacacttattgattgattgattgattgattgattgattgattcattatactttaagttctgggatacatgtgcagaacgtgcagatttgttacataggtatacacatgctatggtggtttgctgcacccatcaacccatcatctacgttaggtatttctcctaatgttttccctcccctagcccctcacccccgataggccccggtgtgtgatgttcccctccccatgtccatgtgttctcattgttcaactgccacctgtgagtgagaatatgtggtgtttggttttctgttcttgtgttagtttactgagaatgatggtttccagcttcatccatgtccctgcaaaggacatgaactcatcgttttatatggctgcatagtattccatggtgtatatgtgccacattttctttatccagtctatcactgatgggcatttgggttggttccaagtatttgctattgtgaacagtgccgcaataaacatacggaaacactaatttcttagggtgatgaaactaatagaaacacagcccttgaatgtatttgtacatattgtagcattcacaattttttcagacctcataattgtcaaaatgaagggtggattttgagtacctctaggatttggaaataaattatgtgactttttacccaaggtcattcaaagacgcttgtgtagcaactctatatttgtattgcaagagctagactggaactttaaaatatcatcagatctctgtcaggtaaactcacagaaatgagcttattggtcaacacacttttttttgcatcttcagggtgccaggcactgggagaatcggggcaccacagatctgactccccacttggtggagctgacagtaaagcaatcacgtcaataatggcagcattctgcagcatatcaacagcaaagtagaatgcaccttggaaggccacagtggggacttaatctagcttgtgggccaggcaggaaagaagggccagcctcatagtgagaaggcttccagggatagtaaatcatgatgtgctgaaggatctgagaagagcccagcagggctgaggtgtagcaggcaggggtatcgcagtaaatccccagcaggaaacagatggcaggctcatcttagaaaacattgtgtttaggccaggtgcggtggctcatgtctgtaatcccaacactttgggaggccgaggcgggcagatcacaaggtcaggagatcgagaccatcctggctaacatggtgaaaccctgtctctactaaaatataaaaaaattagctaggcgtggtggcaggtgcctctagtcccagctattcgggaggctgaggcaggagaatggcatgaacccgggaggtggagcttgcagtgagccgagatggggccactgcactccagcctgggtgacagagcaagactccattaaaaaaaaaaagaaaagaaaagaaagaaaacattgtgtttaataaagggaccatttactatggtatgggctgagtgtcaggacaacaggctagatggtatagggctgtgtgatgatggacttgccaccatccttaggcctggaggggtcaaggggtcatggcgtaattcccagaacctggaaggggaaggaaactttggttgaccaatggaacaagctaagtaggttcattggggagtgagccaagggaatgagttactgagtttactcttctactgccttccagtctcctgtctggactcctgtggccctgaacacaccaaaagtcagagggcatggaatctcactgatgtcatgattactggtcagcctcatgagccagaaggcaggatggagggggaatgaacaaacagaaggaaccctcacaaaacagagagggggaaagagagatagacatacaagagagagctaggaaagttggcagtggccagattttaagagatacttggctcatattaagattaaggtttacttggaagtcactgggcagtcatctgtgtgatcagattattataagaagagaagtagcagactggagggtggatttgagaggagcaagggtggattctagaaggccatttgggaggtcatgacagctccctaggagttggggggaagtgagctaattcaagaatattagaagagtctcgttcagacagctgagtggacgtgcctttcactgatttaggaaacattagcattagaccaattatgggggtggggaaggagaaagcttaagtgcaggtgtgatcatggtcagcttgaaacacctctgaatacaattgggtggggtacaatgtagcagcgggaagttaagtctggagctcagtagatagtcctagatggaggggaatgttgacttatagatgggaatttagcaatggatatagtagaggtctctaaagagcacaggtagcatgaacagatacagaaggcctaggacagaatccataaaaatgtcaacatttcaggattgtgcagagacagatgactgagtaaagaagactgagaaggaacagataagtagtcgaaaaccaagtgggcagggcaggaggcaggttagggtgagttgcaaagtggctgagaaatgagaaaatgaaaccgtgggggctctcatcttctccaggaaggtgtgctgggaacggggaggggagataggggctagcaggcagagggtggtaggagcagagagagccctgctgggaaaggaggacttgagcctacctaaatgatgaccagagtcagtggagaggcaatggcaatggaaagaacaagggtccaggaggaacaggataatcatcagggaaaggttggaatgcggaaggcaaccaaagcatcctgcagagcgtgcattttgaatttctgtgatcctctggaaaaacaaccttctgtgcttcaatttaaaggaaggtgcatggactctgtgctcccctgattctgaaccacactccatcagcaaggccacatccacattcagagctccaggaagcctcccctatccctgtggacaggacttggggagtggccttgtactgcacaggtcactgtctccattctaacctaagtgagggaagagtggattggtccctggagtgtttacagacttggtgctgatggaggggtggtttaaaggatttttagctatttcccccctttctttattaagcagaagagaagactgggtcctgagagtaaagagtctgaggcttgagtaggttagagaaggagaaatggtcattttgtagagcaggagaggggatgctccttagagacactgaaggaccatttaggctggtgacggcaaatttattgtgacacaaatcttcccagctgtgggattttccccaacaacactcaacggtccagacacaggtataaaggtgttttttttttccccattcttcccttcctcttttccttcctgtctgatctatccaagttggagttcattacccacagattctatacataaatgccagtatattctatatatactaaagtctgtagattctagtaattcctaactcaccaaccaactacaaggtttaacaataatagaatcacacatatgtcacctttctaaatcattaacctgagagacgaaagagaagggggagtctgggggcccgagatcagtgactagagggtgttgcagcactaaaacatcacacgattgatcagacctatcatggctctttcactttcatgaacattttgtgttttgctttaacagaatttgagtcactcctataggtggctttagtggtccttccctgggtgttttctcagacttgtggtgggtaatggggtagcatatgtgtgctcacgtgacagagtggagttctcatcatttcactgccttcttggcaaacagaggcaatgagaacgtcaaaggcatcatttgcatttgtaaagcaaaagccagtgatcacatctgtatctaccatatggcagatgttccataattattttgaaaaacatatgagatttcagctgtgcagcacttattggagacttgaggaaagaaatttaggggcaagaaatttaggaatgagtattattttcctcttagaaactgacttctctgacttaccctaaatttagtacttccaaagagaataacagattttcatcattgtaaaatatcagcaaaaacagaccaaagtgctgccataaggaaaggaattctgttagtggtaccttgtctgtctagttgtgaggtgtggtcagctgcgtaatgctgtcacttccccaggatatccatgtctgtattagtctgctttctgttgcttgtaacagaattctagaaatgtgtaatttataaagaaaaggaatatggttcttactgttatggaggctaacaagtccaaggtcaaggggccacatctggtgaaggtcttcttgctggtgaggaccctttgcagagtcctgaggcagcccaggccatcacatggtgaagggctgagtgtgctgctgagatttctctctttctcctgttacgaagccacaaatgccactgctgtgataacccatgaatccatgaatggattaatcccattgtgagggctatgccctcatgaccaaatcacctttaaaggccccacctcttaatactgccacattggggattaagcttcaacattagtttcagagggagtaaacattgatatcataggcttttgcccctggcccccaaaactcatgtccttctcacatacaaatatatgcaatccatccccataaccccaaagtcttaacttatccccacaccaactcggaagtcgaaagtccacagtctcatctgtgagtctgtgaaatcaaaacgggttgtctactttcaaggtacctagaaagactcacagatttctattttcaaagtgataaataggcaaaaagaaaggcttaactagtcccaaccaagtctgaaacccagcagggcagacattaattgtaaagcttgagagtaatctcctttgactccaccttagcctccgagacactggggtgggagttgggcccccaaggcctcaagcagtcctgtccctgtggctttgcttggtgtagcccatgcagctacttctatgtgctgaagtctggtccctgaagctgtccaacgtgggcattgcatgctactggtgactccacagttttgggatcctggtggaggtcctgcctctatggctccattagatattaccctggtaaggactctgcagcagctctgaccctacagttacatacagcattgctctagtggaaactctttgtggtggcaaccccccctgtgacaagtccctgcctgggcccccaagcttttgatgacatccttagaaatctgggtggaggctgccaatcctctacaactcttgctttctgcaaacctgagaattagcaccacatgcatgctgccaagagcctgcagaattagcgctacatgtatactgacatgtgtattccttccagagctgtgccacaagccatacctagggtctcttgagcctaactagggcagttgtggagcaccgttctggagtgcaggaaacagagtcctctggtggccttgggcactgagcctatggagggtgcccttggtctagctcctgaaaccattctgccatcttaggcctctgggcctgtgatgagagaggcagcctcaagatctttaaaatgccttcaggatctcttttttctgctatcttgaggaaaagcacctggctcccttctattcatactaatatgtttagcaaatggtctctgagctacacccttgattttctctcctgaacacacttattaacttttcacttggccaagatgagagcttttcaaatctttctgttctgtttctcttttaattataaattatgtttttaaattattcctttggtcccaaatatcagcataagcagccaaaagtaaccatgtagctccttttatattttccttagaaatgccttgtgtcagaccaaggcagggggatcacaaggtcaggagttcgagaccagcctggccaacatggtgaaaccctgtctctactaaagacacaaaaaattatccaggtgtaggggtgggcacctgtaatcccagctacttgggaggctgaggcaggagaatcacttgaaatctgaaggcggaggttgcagtgagccaagatcaagccactgcactccagcctgggtgaaagaaactccatctaaaaaaaaaaaaggagaagaaagaaagaaagaggagtttgagaccagcctgaccaacatagtgaaaccccgtctccattaaaaatacaaaaattagttgggcgtggtggtgtgtgcctgtaatccaagctactcaggaggctgaggcaggagaatcacttgaatctgggaggcagaggttgcagtgagccgagattgtgccactgtactccagcctaggcaacagagtgagactccgtttaaaaaaaaaaaaaaaaaaagaaagtaagaaagaagaaagaagaaatgccttgtgtcagatatcctagttcatcattcttaagtttggccttccataaagcccttgggcagggacacgcttcaaccaaattatttgccaatttataggaagaatggcctttactcaaaatttcaataccttgtttttcagttctatctgagatctcatcagaatggcctttactggccatatctctattagcattctggtcaccaccatttaaccaattcctaaggagttacaaacttcccttagttttcttgccttctaagccctcaccagaatccaggctttttctagcctgctccctcagcttccatcctctgcccattacccagttccaaagccacttccacattttcaggtgttcactatcatcaacaccccactcctggtaccaattttctgtcttagttcgtattgcttataacagaatgcctgaaactgggtaatttataaagaaaagtaatttatttcttacagttatggaggttgagaagtccaaggtcaaggggctgcattttgttgaaaggtccttttgctagtgagggactctgtaaagtcctgaggtggtgcagggaatcatatggtgaggatgcttagttattgttcaagtctccgtttttcctcttataaagccactaatgtcactcctgtgataatctattaatccactgactcgttaatctattaatcaataaatggattacctcttaaaagtccacatttcaatattgccacattggggattaagtttcaacatgagtttcagaggggacaaacattcaaaccaaagcagtgtactgtctccaaaacctgtaaatgctaccttatatggctaaaggaattttgcagatgtatttaaatttaggctcttgagattagaagattattttggattaactattaagcctaatgtaatcacaagaatctttaaaagagaaaggcaggagatcagaaggatagtaaaagatgtgatgatggaataagaggttggaatgatgtgtctctcataagccaaggaattcaagaggtctttacaagctgaaaaagactttatgaggtggaaaagctttacaagctgaaaaagggaaatcagatattccccatgttccttcaaagggagtgcagcccagtttatatcttgagtttagttctgtgaaattgaacttggacttctgtcctccagaattgtaagagaataaatctgcattgtttaaagccaccaaacttggggtaatttgttatagtggcaataagaatctaatactgtagaataatttactttgagttttttttctctgagtttcaccaatcagctattccaatgtatattcattattgattttcctgcatagggaaggtaatgtcagcaataaatttgagttaatgtgttagctctcaatttacctattggcaatatagattcaaattagagaggaagcatcacctaccccaaagccccagcaatctagttcttttaactcatttcactcccagagtaaaacaggtattttggtaagggaatcactgatgttacttacaaacacaggctctcaattaaaaaaataaaattttctttttggtccaagctttctctttacacacctcaataccatcctttgcctacaaacttaactgtggatatctaaaaatgtctttatagggtaataacatttttccaaaagtcagtagcttaattttagaagtaaaacattttaatggcttaggctatagttttatagcattgggaatggaattttcctgtttttatggtaaatttgtttatctaaattgttctaattttaatctctttaattttgtatgacctttattttatttttaattgaagagcaatatatactgaatgggtgaagtttgtaaaacacttgaaacacacaaaaaagcaactcttgtagttctacaatgtagagagatactgctaacagtctggtatgtcttttattaaacatttacaattaggtgattgttttattctttttttactgcttcatgaacattttcttcacatcagtagacgttcttccatattacacttataatgacaacatcctagtttatcgtatgtatctgctactattagctgatcctctactgtagattcaggtcattcctgaaatattattattgccaattcatgtgctttgctcatttcttttttggtgtgttatttgaaaaataggtttgcaagcttttataaatgctaggcttattaatttttaaaaggtatgtataatcttcaaaggtcattatttgccttttaattttgtttatggtgagctttattgatatataagcattaataaatttcatgcaatcgaaactacttggcattttcatttagggtgtgtctgtgatgatttgtattctctttttttttacagataggttttcttttgtcttgatggtatactggattttaactcttttcttcttttagatcaaatgcatatttccttcttcgtggtggagcagtggtgtttttagtccttaactaaccacttagcttattctgtattaagaacattttttcccacttagtatatttttgaccctaaatctgctggctaacttgatagtctgattcatcttaaagcggctccaggctgaattcaattacaaacataaggatagtattactatcttctgtaaatatgcacatacttacattgtgagttaaatacctaaaaaaagtaatgtgcatctaatgaaggatctttttttttttgtcccagatgacaagataaaattcttagtacatggtttccatttttcatattttggtaatgtccccactattaacaacataaactgataaattagaaaacaccagatccttacaactgtattaaatttgaagaaaaaaatgatttctttctatcaaggtagagaaaaaagaagctgaataagctctgggtttctggaatgtctccattcagctctttctctgcttatgttccaaacaattgcataaaagcaatcccaaacaaatgtttatagggctgcactccgaaataaagataatgaattctacataacaagtacactctttcccctggctgtttgcatttaaaatgtacattttgcagtaattttgatgacttcattttgaagcagttcttaacagacattttggaaatgtctcatgtcatgaatttattcataaaccagcctgtcaaaaaccttagtgttcactggggagaatgtgtctcaaatgcacaagtggttgttccacctacatcatccaccatcttgaaatatcattattcatttccattacttcttggatgttctggttcactgctactgggtttcgcaacagtgtggagaagagaccatgacattgaattaccggctaagcagcatccataagtgttatattcctcccttaattatgatgagaacttgtgtttaggaagctgtgatgtttactgatatggttaatggtcaatgtcactcatcaaaagggtgataagacaataatgggatcttggaacagggaagtcaagataagcacaatgtgtcattttttcccctacaagcatacagtccttaatgaagacaaataggccctaatgtttatttgttcaatgaacatgctattggattgtgaacaagaggtcagcgtgactagcaatgaggtgtaagctgctctatcaaagggtgatatttagtgactagagcaagtcctagaatgttttacagtaaaccattgtagttacaacacattgtttctacccctctgatctccaagagacaaggaaaataagtggatactcttgtctttccaatctggaaaatagaattggaagtggatgctttttttcatttctaattcatagctctttgatcttgattattcatgaagcatatgcgtccatgaccatgtgttaaatcagcacttatcatattttattgtgacattcattcctgggaattttattaaaatgcagattcttgggtgggagctgagattctgcatttctaaccagctgtcaagtattactcatactgtttctggtccatggaccatactttgagtagctgactgattccaacttgcaagacagagacagcagaacctgcctacatagatttagaaccttgtctcataatagtgcatgtatgcttagtgaggcagcatagtaacatggataaaagtgcaggctctgggtgtgaattctaccactacttttgctaagctttgtgtagtgccagtcacccctatagtctctgtgatcaatgacaacaaagatttattttgtgctcacattacgtgttggactgactgttggccacaagtgtgcaaattctgggaaccactttaaagacagccttctctgggacatgccattttaccctcatcttttgggaacctacaatgactaaaacttctgctcggatttgccgatgtcatgtccactcacatgctattggcctgagtcaggaacatggccaagcctgatgtcaatgaagcagggaagtagactccttctgcacacagcgtgtatagacatatggcctcctgcaggaaagggagtgaagagttgggacaagaacacacttttccattgtgacttagtagctatgtactcttgttattttcacaggattgttttgaggattgaataagctaaaatggatagtacattgtacctacatgacacttaggagaagctcaataaatgcctgtaattataattgcttttgtttttgttctcatacttcaccctagtcctcactgcacagttgctgtacccttgaggttgagaaaagtccctctccctgcctttcatgatacatgaaacatactgaggcccactaaataccaaacaatcagatcatctgaggcatctgcagttaaagaaaactggattactacacaatcagttatttccaaataattttagacaacgattgacttcttcctggccatcatattttctgagtttttgacttgagtttcagatcactagatttcccctgattattctctgaatttgttttatggcctgttcttgggtcgtttgttctacagatgtgtactgagcatccagtgaaagtcagctgttgtgtgaggagcaaagattcatataaagtgtggttactatttaatgaaagtttgtgagtacactcttcatagacgccctcattcactgttatctaattgccaggcagtgctggatgagggtgcaaaggtgaaatccagcctaaataaataggagtctggggagcttgagcatatttagttagccaaggggaatcactatagcttgtgaacagtccaggaatatgaccttggatttcgaaaaaaaaaaaattgtgggtagtatatgtaagttgttggagcctctgccattgggcacttggtggagtgagattatagggctgtgagccagagcatggtgtagtgaatgggatagatgtgtttgtgtgagaggaaaatatccagtggctgcatagctctgaagattatcagtccaggcaattgtggacaggcaataagtttatgtgatggaggaggtagtgcattcaactggggccgagagtttgcgttgtgaatagtataacaagacacagatgttggaaaaaggggttcaaataatttgcagaccagctatccaggtcaactagctgatgatccatgacacagtgcatgttaaaggcctatcaatcttattgtgtagaaggagtatagaccaagggatacgtagtcattaaatgctgaaggttgagatccttgttgatgcaattgttcactttactaagaggtactttttttttttcaatttgactaagaacaggcctgaagattatcagtccaggcaattttggacaggcaataagtttatgtgatggaggaggtaatgcattcaactggagccgagagattgtgttgtgaatagtataacaagacagagatattggaaaaaggggttcaaataatttgcagaccagctatccaggtcaactagttgatgatccatgacacagtgcatgttaaaggcctatcaatcttattgtgtagaaggagtatagaccaagggataagtagtcattaaatgctgaaggttgagatccttgttgatgcaatggttcactttactaagaggtacttttttttttttttttccaatttgactaagaacaggcgtgctttactcataacacacttgtttttggtgcagtatatcgcaaaacaaagttgctgtgttaagtttaactgtgatttaaactgatgttgcctgagtccccaaagaccaatgaaacacaagtgggatggaaaaagcagccacttctattgttgccaaatgatagaaaagatttgaaaaatcaaatgcatcaggttagcctcactgtgcagcaaggaaaaaaatgaattaattataaataagatgaataaataatttaaatatatcacttattgcttctttattgcttaacacttgaaaaattgtttcaattagaaacttaaactcaatttgatagacgaagagtgtgcagctcaagataaatgtaaatccctttgcgatataaaaatttgattttgcagtatgagctctattaaaaagaaattaataatctctagaaaaagaaggcagtgccaaggaaggttggccttttcccacagaacattgctttttaagaggaaaaatcagtaagcttattatagagaaaattttttaaaaaatcagaaacgcaaaatactaaccaccaaccccacaaacaacaaaactaataagcatttgtctctctggatttcatattaaaaccgtagagtaggtttttgtgcttcttatatttcacatgattttttgtctaagccagacaaaatgcttcattctctctttgagtttgttgggcctataaaaaatggtagaacagtccaggcatcgtggctcatgcctgtaatcccagcactttgggaggccgaggcaggtgaatcacctgaggtcaggagattgagaccagcggggtcaacatggtggaaccccgtctctactaaaaatacgaaaattagccagccatggtggcgtgcgtctgtagtcccagctacccgggaggctgaggcagaagaatcattggaacccaagaggcagaggcttcagtgagccgagatcacaccactgcactctagcctggggacagagtgagaccccgtctcaaaaaataataataataaaataaaacaccagaacaatttcatattttttgtacctaaaaagcaagggatttatgtatctgaagtcacaatggaccttacccaagacaagagtatcctggaaagttgctttgattcctgtgccatcatgttctaatgctgcaaaccctctctccgcattcttggcagatatggccaattaatgagatcatgatcttttgtatgtccagtctaaacctcagaatccctcccatcacaggcctccagccagccacttcttggcacgtggtatgaaacctactgcccatctgtcccagcagctgaaggactaagagttcaataacattttatctggcacatgaacaatttgcctgatttcttaactacgtgcaaacatctatcaccttatgttttagttcagtctgcagaaatgagttctttctattatgtatagaaaaaaagcaaatgtctcaggaaattatgtggcctatgtattttaccttttggacctaaatatacatctaagaactaaatatggcctgagaatcagctcccctcctccccagaatctcataacaaactgaacactcatcatccatcaaaaagcaaacacaaaataagaaaacaccagctgggccacaaatgccagtccaggcagctttcaattaacattcagagctgtcagaaactctacagcaggggtagaaaacggatggtctcagcccacagatgtcttgcttggccagaaggagttttatttctttattctggccctatgtgggtcccctcctctccaggtatcataggcttccatactgccccattctctttatcccagtgacatctgaagacccctgactttgtgattcctgatggcagaattctgtctttcctcattctcagtcacatatccgtttatctctcttttatggactgaatcatgttcctccagaattcatatgctgaagctgtaaactcctaatgtcactgtatttggagataggatctttaaagaggtgtctaagttaaaatggggatattggggtggcccctaattccatgtaagactggtatttaagaagaggagatggccgggcacggtggctcatgcctgtaattccgaggcaggtggatcacctgaggttaggagttcaagatcagcctggccaacatggtgaaaccccatctctactaaaaatacaaaaaattagccaggcgtggtggcgcatgcctatagtcccacgtactcaggaggctgaggcaggagaattgcttgaacccaggaagttgaggttgcagtgagccaagatggcgccactgcactccagcccgggcaacagtgagactctgtctcaaaaaaaaaaaaaaaaaaaaagaagaagaagaagagattaggacaccgggacacaaagagggatggccatgtgaagacgtgcggaggaagacgaccatatataaacctcaggaaaaaacctacctccaaacaccatgatctctaacttctagcctccagaactgtgagaagcaaatttctgttgctaagatccagagtctgtggtctttcactatggcagcccagaccaactaagacaccatctctagtcctgaaatcgtgaggaagcagcactccccaagtcaatctacattcagtgagctgtggggaaatggactgcagtgctgagcttcacggcctgagtccctaaggttgggatgaagacaatgtgaggagagtcactttgatttatagctccaacaattatgaagcctcttaggaatagggcaagaaagcattttactgtgtctcgactccaagaactataatgacatcttttaaaatttcattattctttttgtttttttgagacggtgtctctctctgtcgcccaggctggagtgcagtggcgcaatctcggctcactgcaagctccacctcctgggttcacgccattcccgcctcagcctcccgagtagctgggactacaggcgcccgccagcacgcccggctaatttttttgtatttttagtacagacggggtttcaccgtgttagccaggatggtctcgatctcctgacctcgtgatccgcccgcctcagcctcccaaagtgctgggattacaggcgtgaaccactgcgcctggccttaaaatttcattattctatttacaatataaatagcaatactaagccaacgtaagcggatattgtcagtgttgcacgctttattagagcttcttggaagatagacataaacacaacctgccatccagccgtgtccacgtgatggcttggagaggcttttgcttcagcagccagtcagtactaagcatatttctttttcttttctttttttttttttgagatgaagtctcgctttgttgcccagtctggagtacctctgcctcctgggttcaagcgattctcctgccttagcctcctgagtagctgagattacaggcaggtgccaccttgcccggctaattttttttatttttatttttagtagagatggggttttaccatgttggccagggtggtcttaaactcctgacctcaggtgaaccacccacctcagcttcccaaagtgctgggattacaggcatgagccactgcacctggccgattgaatgtatttttctatgaagaccttttccctgttttatgaagcatcaactgtgcattctgggtggaataacaaatctgagtggaatacttactatttacttgttatgtgcttcctagaacatgttacaaattcttatttattttttgtgctgtatgctatagcatcccaaacatctgtgatgctgtgttacactagagacaacattctcaggcttgcatgcacactcacatacacatgtgcacacacaccctcataacacacaattactccctccacaagtcaatcaaccaatcatttatacaacttcatcccatagagtgttctttaaatttcaagcccatgaaggatggtgaattctcaaagcaatttcattgcagagggcaaaacgagctgtcagaactagtataggttctattaagggtaagataaagtaaactctaatcagggccagtaagaaaaagctaactacgagaagcttgagaaagataaacgtttgcctggccaacacggcgaaaccccgtctctactaaaaatacaaaaattagctgggtgtgacggagcacacctgtaatcccagctactcgaggggctgaggtaggagaattgcttgaacccgggaggtggaggttgcagtgagccgagattgcgccactgcactccagcctgggagacagagcgagactccatctaaaaaaaaaaaaaaaaaaaagaaagaaagaaaaacgtttgcatcctagggggctatttaaccaaaaggtgtatggctcctgtgagctccagatagtggcttgtgaacctctgatattagaaaggataagaaatcatccgtttctgtactgagcctcaaagagaagactcagccctagttaggaaatacaaacaagacctatttccgctaaattggcaaagccaccaatcagagccatatagactttgtgtggtcaagcttcccaccactgatttcatgactcctaacggtagaattctgtcctgtgaggctgagaatgaacatctaactttaagaaatacagcagaggccgggcacggtggctcacgcctgtaatcccagcactttgggaggccgaggcaggcggatcacgaggtcaggagatcgagaccatcctggctaacacggtgaaaccccgtctctactaaaagtacaaaaaattagctgggcggggtggtgggcacctgtagtcccagctactggggaggctgaggcaggagaatggcgtgaacccgggaggcggagcttgcagtgagccaacatggtgccactgcactccagcctgggcaacagtgcaagactccatctcaaaaaaaaaaaaaaaaaaaatcaatctactccttgcatcatgtgtgacattttaattacctaggcagcttatcaggacataatgaagcagctgctatgattatagaattttgtcccaattatttacaaagctgctcagctacagaaatgtctcattgtcatatccagcatgcttaggttctagagcaggtgttaagcctgatttactggccaaatcagaaaattattccatggccgtcactttttctttggagccaaaagattaaaatttaagttattctctgaaagtgtgattttttttttttttaatcttgattgtcttcttccggctatcagctatctttcctcgtcgtcctgaaggtcttaatgtttccctggtttcattctctgtcttcttggtgttatcaaactctgctctatcggcacccttccaacaggtgagtatgcaatattctgattctcccaaaggataagatgaagcgtttgtagcaaaatgcttttcacagacccctagtaatacttttttccaagcataatgaataccgactatgcgccaggcaatgagataaaaatactcatatttttttctagtaggaattctaaaattagattctgattgctaagcagaaaacagttcttttaaggctacctctaaattgtggtgctatatggttgctgaaatccataaaacagtataaaaaggtcaactgttaaattaatctttgtgattgattattgctgtccttgcaataatctggtttaagttagaagttgcattgtggctttagttttaaatcgtcacagaatcccttccatatgcttttacagaaaagagagtatgatattttaaaagaagttcacatggaacattctctagggaggtagacatattgtgtgggcctaaatggatgaatttacaggatgctggaacttggagaaagtggtcaaaagtagctatcactgcaagttacctaacattactaccttgaggccggggaagttggagataagaatgagtgcttccaaataaaaagcagatggaagaaagggacctatatggataagagatgaatgagtttctactgaggaggccatgcttatgttcccattgtgactgggatggctgagatacagtacttcctctagtgaaggtataaaacaaaagttatttttctcattaaaaaaaagttacactttaacacaaaggggaaccaaatttacttacaaacaaaacaagtaaggatagacagggtcacacccccatggcctgaatttgcataatgttgtccttttagattaagaagaaatgtgtgctgatgaattgttcatttttattcagagcacagaaatctagtttcagaaaagaagtgtaggtctacttgagtcataatgttttcttattgaataacatgcattcatttcagaactaaatgcatttagtttattgggaataatgaagtaattcttggaagagggcgaggaaagtggacagcatgttttattctggtgttgatttgcttggatgttccacagacagtccaagctttttgtaggtcagagaaacatccttaacctggggcaaactttgacacccagcagatgccttcaatcctctttatctatcatagtgtctgtttttctgtggtctcttttactacttcaggtttgctattaatgattatttgaactcatttcctcagtatacaattgggggaggagtggagaagattaatgtcatagtgtcattttttccctgtattttgtgggtctgacctcgaattctgatccttatactctcttaagtttatacatggatagaatgttgtatcagaatgtacttataatggttgcctttactaagagtatattaattatgggttgagcttataattaattgacttcatgattgtaaaagtgaagggcctggtattacaccgaactgcttcttagcacaaagtaggaactcaatatatatgagtggaatggatgaataaaagtgagtataaataaaccatgactgctaagatgaaccactgttcaattgtaaacaatgcaagataacccaatcgttttgacattatgagggacgtgcatcttttcttgagaaatggggtgagacattaagtcaggggcctgatatgaggaagtggtagattcatttgtaccagctgtttagtgacaatgagaagagattacagaagtccagtgtgtctagactaggccacatgtgatttttatcttaaatctgatagtggcatgccagttaggacacatcattcggcaagatgtaattgatatctcaggtctgggaaaaaaccttaaattgttttgtgctcttctgagtggctagtatgcaagcccgcacatttaagattgacatcacttttgagggtgtttctgcccctgagtagggacctgccacatggtggcaaatgtgtttctgtgaaatactttcccagcctgtatttcatggactagtcctaggtggtctttgcaaaatagaaaaaagctgtgtccatgttcaatgattcaatgtatttagaaaattgccatacgtttcaaatcgagcccttgggctttggaatcaggcagggctgggttcccagttggcaagtttgcaaactgtgtcatcctgggaaagtaacttagcctctctgagtttcagattcgtaatatgaaaaataagaataataacaccaaattttggggactgactgatgattaaacaggattccatatccatatcatatttaagcaattttagtggtagcctatagtaactaaactataaatattagtgattacgaccattattatgattagtattggtttctttctcttgggtatttaaaatagacataaggaactctgacgaatcccaaggtgaagaagtcactgacttgccttaaccagcagtttctcactctatttgaccaaaggtctggctttttcacttagcatgaagatgccatgtcccctgcagcaccttttgagaaaacatctaagtgcactacttctcaaaattcagtgtcccttcaagtctcctgggtgtctcgttaaactgaagattctgattgattaggtccaggtgggctcaagactgtttctaaaaagctcccgtgtgctgctgatgctgctggttcgtggacctcattataggtagcaaggactgggagcccgtgactatggtacctgcatgtctgaagtttatatgtggatgatttctttctttctctttcttcctttcttcctttctttctccctctttctttcttccttccttccttcctttttttctttctttccttccttccttccttctttctttgttttgttttgagactgagtttcgctcttgttgcccaggctggagtacaatggcacgatctcagctcaccacaacctccgcctcccaggttcaagcaattctcctgcctcagcctcccaagtagctgggattacaggtgcccaccaccatgcctggctaattttgtatttttggtagagacagggtttctccatgttggtcaggctggcctggaactcctgacctcaggtgatctgcccacctcggcctcccaaagtgctgggattacaggcatgagccactgtgtccggccagatgatttcttttagatgagataattgcatatcagcattagggaaaaaataccatctcaatggaaaatgatgatgggagtatgtggaaaggaaagaaactagtagtctaccattttatgtgggtctgtctctacccttctggactgtaaattctctgaggaggcagatgtgttggtttcctcactgctctatcccaatgcccatggcttttcttggcatagcatagacagatacatacatattaaatgactgaatgaatgaataaatgaatgaatgaacgacaggacaccgagtcttttcatcctgggagtcccattacatgccacatcccagaggttggcgggaagccatactgtggtaactgaaagatatgtacaagattaggatttaggcagcatacgaaagccttacttttatgctttatttattgaaagtactctctattttttgttaaaagtctgtactgctattctcctgataagtgtattggccagtgaggccttcctgcccttattttaggaaacttcaggagcaccttttccatggtgggaccacaaaggcagttttccatcagagtaattccacagtgagctcaaggaagggtacaaggatggattgaataatttctcttacagctcctgaagctctctacaagggagtattttcttattagtgttatcacagctcctggaggataatagacaatcaactgaggaggtcctcaaatgagatttctcacagatttgctcatcagtgtggtgcaggttcatagctttaaatctcaccaaagatagtttatgtttgtggctcaatgcaaattgttttgcccacatctaaatttatttccattttatttgtattggtctctacttctaaaaagcttttagtgcagaatcatcgagttgacttggaagttatctttctgtgcatttagactttatgaattagaagactaaatggtatattttaaatggatataaaaaatcaaatgaataaaataggccataattcagctttgtttagaatgaatattgtctcagttcacttgggctactataacagaatgtcacacctgtgtgcttctcaaaaaccaacattctccccccacagtactggaggctgaaagtctaacattaaagcagcagaaggttcggcatctggttagggcctgcttcctggttcgtagatggtcatctcctccctgtattttctcacagtggaaaggaaacaagagcactctctggagtcaattctatcagggtactaatcccattcctgagggcttccatgaattaatcacctcccaaaggctccatctctgaataacatcacattgggggttaggatatcaacaatgaactttggggaggcacagatattcggcccattgcaaatatatttgtgcaaaggagattctaataaatgttgacttgtttctgtatgttaatccaaagcacgttgtattagtccgttttcacactgctgataaagacatacctgagactgggtagtttataagaaaaaagaggtttaatagactcatagttccatgtggctggggaggcctcacaatcatggtggaaggtgaaaggcacgccttacacggcagcagacaagaaagaatcagagcctagcgaaaggggtaaccccttataaaaccatgagatcttgtaagacttattcaccaccatgagaacagtataggggaaaccgcccccatgattcaattacctcccactgggtttctcccataacacatggggattattacaattcaaggtgagatttgggtggggacacagagcagaaccatatcacatgtttttgtatattctctaataaaatgaataataaatagttataaatatataaaaatatttatatatttttgtatatatttataaataaaataataaaagatgagttattttataaatttgttttaaaagaaaattttcttttaaaatattttcttttctccaaaaatattgcatacctattagattatatacagaagcaaatttgacctttccaattttttaaaggtctgtatgtgaagaaagagaagaatgcgattttttaggctactttgagctatgctccccagagttctttaggaagcaatggattcttcaaattgggcatccttaaagcatcacagtcatttgccttcaacaatgcagtgctcatggacatatgaaagacattttaatgcagttttacatgtgacaagttgaaagcgtcttccaagagttccaccacactggtgctgtccactccattgctcgggattctttgcagtgatttttgagaggtgtgggccttttcctctttatgtgtcacgtgactccacagatgcctttcctgtgtcacccgcagcagatattactttcccaattaaagtccttttaaagaatggcttttctccaaaagtggaactgaggccttttagtggtttcttgctatttttgacacacatacatgtatgcatgcacacacacacacgcacacacacgtacacacacatgcagatagtagcaggtttaaagctacacattccacatcaatttctccccatccctggcttccaagtgcacggtttggtattgctgtctgtgttacacaggttattgctgcaatcccatgtgccggtgctggtcaacactgaagagctgtgcccgcacctcatctattgtaaatcagtgccagccttagggtaaattaccttcctggagtgagaactgtaacctgctaatgctgctatgtaacagtctcagcaatgtctgactccttcttcggaatgttgttattgaattaggtgttatccaatgtccacttttacactctcccttctctcttttctgtaaagaatttggttgcattgtttgtctcaaggatgaagaaaaataccaataaataccaccagcaacctcccctggcaggttcaggacataagctccataatctgaatttccctcctatgtttcatgaaggtagatgatgtaatccctatgtgatccgcctcagggcagtcatgttaaagtgtgacccacctgaattctcaactaaaatttaccatacaaaaataagtggaaggtcacttgcattacggagaagcaattcttaatatgacacttatttatttaataagtacagactgaatcccagctatgtacaaagcagaaagtgatttttttttatttattttatatttatttattttttagacagggtctcactctatggaccaggctggagtgcagtggtgtgatcatgcctccctgcaacctcaacctcctgtactcaaatgatccttccacttcagcttcccgagtagctgagtctacaggtgcatgccaccatgccctggctaattttttgcattctttgtagagatgggacttcaccgcattgcccagactagtctcaaacttctgggctcaagcgatcctcccgcctcggcctcccaacatgctgggatttcaggcttgagccactgcgcccaaccaggaggtaattttaaaactcacaagccacacttcctttctgtgagaagtttgtaatttaggatgaaaactaagatgcttaggctaataattaaaatgaaagcccattaccgattcaaagtaaaatagaagttaagaaaggcagaggccacttatggtcagttggttaggaaatagttgctggacgtgataccattggagttgggcttggagagtggggcttaatttctggcaggactagaagagaaggtttttttttttgttgttttttgtttttgagatggagtctcgctctgtcgcccaggctggagtgcagtggcgtgatctcggctcactgcaagctccgcctcccgggttcacgccattctcctgcctcagcctcccgagtagttggtactgcaggcgcccgccattgcgcctggctaattttttttttcttttttttttttttttttgtatttttagtagagatggggtttcatcgtgttagccaggatggtctcgatctcttgacctcgtgatccgcccacctcggcctcccaaagtgctgggattacaggcgtgagccaccgcgcccagccaagagaaggtatttaaagtagaggaaaatgggaagaagatgcagtagcttgaccatttaatgatgaaacctagtgcagtttggctacagaatgtaagtaggacatagctgaggtctgttgagaagcaataatggcctgggttggggtggtttctatggaaatgcaaagaaaagttaattagctcacagcgtgagcttagtacattcatctctctgtatgtgtgggggattggtttcgggacccccaagtataccaaaatccaggcatactcaagttcagaagtcagccctatataacctgcatataaaaaaaggttgtatacttcagttttccatccctcaaatactgcattatcaagctacgtgtggttgaaaacaaatctgtgtctaagtggacttgtgtacttgaaatccgcattgttcagagagtcaattgtatgtacattggaagagtgattgcagtaatgaatgctatttactaatctgatgttctgccgttctatatgctggaaagtaaacacatgataaaatttaaaatgtacaaaatgggccaggcacggtggctcatgcttgtaatcccagcacttggggaggccaaggtgggcagatcacttgaggccaggagtttgagaccagcctggccaacatggtgaaaccccatctctactatttttagtagagatgttaaaaaattacccgggcatggtggcacgctcctgtaatcccagctactctggaggctgaggtgggagaattgcttgaaccccggaggtggaggttacagtgagccaagattgtgccactgcactccagcctgggtgacagggtgggactccgtctcaagaaaaaaaaaaatgttactattaataattcaagagatacatgttaaacatcttgttttgattttgtggaatttaactacatcaatcgcctgaaatatggccacagaaatattctagtattataccatatttagtgtacataaacaattcaagtactagtctgctagggtcccataacaaagtacttcagactagtggcttcaacaacagaaatttattttctcacaaacctggaagctggatttctgagaccaaggtgtcagcgaagctggactctcctgaggccattctctgtgtgtctttataggcccacccctctacatgttcctgcatcctcatctcttctttttgtaaggacaccagtcagattggaacaggacccacccatatgacttcgttttaccttaaatacccctttaaagaccctatctccaaacacagtcacattctgagcaactggggattagaaattcaacacatgaattttgtggggacacatttcagccggtaacactccacacacttgacttttcaagtttcttataatatttttagttcataaataggataacaggagatatatatatatatatatatatatacacacacacacacacacacacacacgtttatatttggaaataggtgaggcacaaaattataaatggtaagtaaaatactgaaacccaagtcacctttacaaagtttaggtggccaagaggttgcatgtcagtttctagagcctcatcatgccagtatgcaggtgggtggtcccttagcttctgatagaaagaacatgggctctggaactttgtttggaaagaacacgtgcttcagcacaacttgcatttaaggccagattctgctatttacaagcagtgtgacttgtctggctctgcttccttgacattcaaatggagacgatgacatctacatctgcgattgttataattgagaagatgcatgtagaaagccctaggctcctaactctgcttgtaaaggtgagattcctacatggtgtgaatgaggacacacttctgaatttgatctgtacatcaggtgtctgttttttccttcccatggatatagctgtatatataaatcttagttgtcttttttaaagaaaacccaagctccttaccatctggtctctgcacaccttccttaccccacccagccctctgctcactatgcagtggccacatgggcatttttctattccttggtgatacccaggtaattccacttcaggctctttacactgccatccctttgccaggcccggctgtccctccaggtcactcaagtcctggctaagggtccttcacttactatgtattctgaagtcacctcccatcaactcacctattttattttcctcttaactttttatcatataaaattatttattgatttgctttttataccatttgtcttcctcacctttccccactggaatggcagatccatgaggacagcagcttcgcctctcttattccctattgtaaactggaatagtgcctgaatttgatacgcatgcaatgagtacttttacaagaaaatgttataaatgtgtaacagcattgaagggtataaacttccttcagataaatttggcaatacatattaaaaattaatactgacgtctgaaccaaaatttctcttcgtcagaatccattccatgaaatgattgaggaagtttttaaaaagtttaagtgtgtttatcatcagtcagtcaggctatggtaataacatcctaatagcccgtcttgcctctctctactctccttctttcatacttcagcccaaaatacctttcattcccatttttaaaaatacaccaaaatgatcaaggttaaaaagtcaaaagtctaatatagtagaaaacaatagttagctattccatcttttctgagcccttccatgggcaggattattcaaacacaagtttagtctactcacactctttttttttttttttttttttttttttctgtttttgagatggagtttcgctcttgttgcccaggctggagtgcaatggcacgatgtcagctcaccgcaacctctgcctcccgaattcaagtgattctcctgcctcagcctaccgagtagctgggattacaggcatgcaccatcatgcctggataattttgcatttttagtagagatgggttttctccattttggtcaggttggtctcaaacccccgacctcagatgatccaccctccttggcctcccaaagtgctgggattacaggcatgagccaccatgcccggcccacattctttatgatttttgatatactgaacttcttttcacaccttacttttgacttctatttgtcacactttatcatccttatacatccttctttctttgtttaataagtttttcttttttacttttactgtacttacttagaatgtatatattctatttccatttatttagatgttaccttggaaatttaccatgtacatttaaattagcaaaagtctgcaattaagcaataacctaagcaccttcttccatgaaaagcaaacaaaaaacaaaagcaggttttggagcattttgattctgaacactcacctcaaaacctacatgcttctgggccaggcacggtggctgggtgacagagcaggactccgtctcaaaaacaaagaaacaatcaaacaaaacttacatgctcctgttgttttctctacttctatatatttatttttttttaacccagatactaggtattattttattattagcttattcagatgttatttctttggatttgcttactgttttataatttcatttgttcattcttacttggatcccaaaccatctttttaaggtcgtgttcctttttcttgaagcatatcctttagaattttctttatttcaggtttctttgtggcataccctctcagtttttgttatctttacccatccttgttttatctttttcataaaagagtatttggctgggcacacaattctgtactgactatatattttccctttgtactttggaggtaaaatatcattatcttctagctttcattagtgctgttggaaagtctgaagtcatttaaattgtttcctttttgtaggctgtttgtccttgctctatggcttcatttaagatctcctctttgtttttgatgttctgtaattttgtcaaagtgtgtttggacacaaatttctttttatatattctgattttatttatctcagtatattgtacttttgggatttttaatacatattttctgatagttctaaaaattgtatctttttaatgattttcttttatattcctgagattccagttagttatctatttagtcttctcattctgtattttatttatcttagtgtctctttcacattcttcatcacaattctatttttgtcttacaaatagattatctcctggaattcttaatgatgatgatgatgattattttcgttttctcccgttttctgaattgtgtttcatccaacgtttgtatttttatatttgttgccttggtcttcctccttcatgatgcaagcattccttgaatatctgatggctgttgatttccatttatattaaagattgagcagataggaaggaaacttatataagtgggcaagggttatggaatagtctttgttgctttatgatgtgctgttgtctgaaggttttcggctcccaccaaatttatatgttgtaacctaatccccaatgtgatggtagtaaaaggtgcagtctttgagaggtgattaggtcataagtgtggagctctcatcagtggaattcgagcccttataaaagaagcccaagggagctcattggccccttccatcatctagggacacagcatgaaggcgccaactatgagcaatgaaccctcaccagacactgaacctgccagtgccttgatcttagacttcttggcctccagaactgtgagaaatacatgttgtttataagtcatccagtctatggtatttttgtgaaagcagtccagcagactaagatatagtgagagagatcggtgcttcagaatctgctgacatcttttggttgctgacagcttttcctgttttctttgccataatgattttccctcttttcttagctcattactcttattttaaggaagcttaaagggaatatcaatagctcattctaccatcttgaattaaaagccacatgtaattttttaagaagaacactctcattatattaatctcttgcttgaaatatgctccttgctgcccattgctcatagaacaaagaccaggatccttacgttggtccccaaggccctgaacagccttctccccagagaatttccaccttcaccttaaatcatgctccatctggctttctgtgctcttttctcttctgctagtccacaatgactcctcctgtctaagggatgtgcacacatcatatgctctctgtctgcagggcctttctccttcctctggccctcacaacccctgctccacaactgcaacctcctaatagatcaatttaccctcttgtattatctcagagcatcagagatcttctttgtagtacttatcaaagttgtgatttttctttcatttctatgactatttgattaaatctgtctcatccgcaaatagaagtgggcagctgatcataatcctgaaagacacagtacctagaacaccataatcttgaatgttgaaatcctagaaagtcaaaatttgcaaagtctaaaatcctgaaaataacaacactgaaagatcaaatccccaaattataattctggaagaaataatataaaaaattatattagaggtatttatttatatttttaaagggggatttattggaaaaacataaaaacatcatcgagaaacatgataggccactttacacaataaaataagcaataataacataaatatttttgcaagcataaacactcaggtatactaatgatagtcacatgagcataacagttaggaacagacagcacatattcataaagaaacaggctaaaaagggaaatgtataaattcacatcactatggttggttattgtgtgcacccagctttctaactacagtcgtctgaaataccatgatgaacaaccttagtcttttgacgagtcaatcaaaactgcaaaggttcgccaccgcatttgcaatcgcccaaagaaccaagatctccagaaattgcatctttcacagatacaaatgtacaaaaaggacatctcttcatttattgaggaagttccaatgtttatactttgagaaccagggatgccgacgatgtgtctctcagtccaaggttgaaaacctcaggatcctgggagctgctggtgtaagttcctagagtccaaaggttggcgaacctagagttctgatgtccaaggcagcagaagaaacatctgtcccagctctcagagagagggatctgtgcctcagaatccgttgtaagcttttgttgctgacagctttttccaatttgccttctgtatttgttctttcctggtgcccagcgaattggatggtgcacctgacaacatggaaggcaaatcttcctcacttagtccacccagattcatacggtaacctcttctggaaataccctcacagacacactcaaaataatactttaccaggtttctaggtattccttcagttcttaatcaagttaacacctaacattaagtccactggtgaccacattaagtcactactggtcaacgtgggtaacttggcacccatattcctcgccttaaaccatgcttaataacaagatggctagatctgcctaacatgatgcaactattttctgatagtgattttcaagattttagatattagggattttaggctttagggatttgaactttgagatttttggtctttagggatttcaatctttcaggatttcaatttttgggatcatggcatttgtgattgtgtcttttgggattatgatacaaacccaacaaggggtcagattgggtttgaaaatgagcaaaattattttgtaaaaattataattatatgttatataattattacataataattttgctcattttcattccttagtctccatgtagtgaatgaatgcataactgaatgagagatgaataatagcagtaaaggaccttggatggtttatcttatgctattttttgaggatattcaggagatctttgttgaatctgttccatgatcatggtaagatgtttaagctgaatctcagactcaccgagatagaagtaagtgatgatgaagtaagtgatagaactaagtgatgatgaatgtggcttccagtatgaacatgacttatttatgtctaataatgtgttccatttgtacagaactttaggctttttaatatagtttcacatattcagattaattttatcttcatatttttatgagacattttgttggttcatttagatgaactggaataagactgactcatgtctctgcaggttatgagacacatttagaaacgaagatgctaggatcatcaaccacatggccaggcaacaaagaaggaaaggaactgtcactcatgtgtacctttccgaaagtggagcctggaaggctgtttgagctcccaggcagtctggagcccatgctgttccattgctccttcatgtacaacccacggagcttcacctgaccattaacttcactcagtttgattcccagcacaccagcctctgtctatgtctctctcacatcactttccactatgaattatgcttgttcttcccctctatcacttctatgctctttcactctacatcttttattaaaatctcagagagagagaaaaaagattggtcttagggcagaactctcatagtaactaagtcacaggccgcctgtcctgtatgatgtggtgtgcaaagcactgttgtcttaaagtgctctggaagctcccttctggttgttggacagcatctcagctagcacttccccttgttcccagtggggaagcctcaacccaatttcagcttcccatgggaccaatatcttcctttttcagggtaggggggatgcatctgaacccagcttctactgtgtcttcaaggcttccgtattctggggatctggactttccaaacagttgcttcaaacagctgacatctaaattcatcctgcctggtgccccggtagctggattattcccttacttacaagattgctctcacacttgccttgtttaaagggcaggcagcctagcagaggggaacttcccctagaattcacagccacactgcctgcccaccacagtgtcttggcccaaatgcctttctatggcatcagagggaaaatcaggggcctgtgctttcttttgcttacttaccttggcttgtaggcactttgctgaaatgtgttaggttggtgtagtgggttgaacagtgtttcccaaacattcgtgttctcctggtacctcagaatctgaccttattttgaaatagagtatttgcagatgtaattaagttaggatctggagatgagatcagcctggacttactataagccctaaatccaaggactggtgtccttctaagagagaggagatggaaatttagacatgaagacacagggagaagaaggccatgtgaagacggaggtagaaattggagttgtgtgtctacaagccaaagtatgccaaagattgctggcagataccagaagctaagagaggcatgggaattaacactgcctacatctcaattttggaccaaatttctattgtttaaagcaaccagacatgtggaagtttgttatggcagccctcagaaatgtaaacagctgggtttcctagaagtagaacctgagaagggggttctcgtgcgagggactgatgaaggattggttgaacaagggttaggtggggagctgcgtaagtcagggatgtggtttcagctggggactggcctctgtctgacctcacaggctggctctggcgcacagagcgccctgcagggatatgatccacctgtggcaatagggccaatgctttgacccctaggtcagccagttactgactgtgggctgctgggagtgagcaatgcctccagcaggagctgctttttatttgacagaagacagctctccgggacagggtccaccaccgcggcgattatggcaatcgttatttcttaaggcaaatcctgtgaagttatggaatttgttacgggccctggtccataatggtggcagccacgagaggacgtgatttgcgtgagtaacacccacaaagggaaccacgttgcacagcacagcagatgcccaccattccggcagttatctgtatttgggaagggggaggttgtatgatacagagaggaagagggaatttggctggggaggccaccaaaccaagacaggcagttggacatgggcagggctcctgctgagggaactaagacagttcctaaaactgcctgagctctatgcagagccacccgcagcaggaggtataggacacaggtctgacatgcctataactgagaggaaagagataggcaataaccattaaatcaggctgggcacagtggcttatgcctataatcccagcactttgggaggccaagatgagtggatcacctgaggtcgggagttcgagaccagcctggccaacatggtgaaaccccgtctctattaaaagtgcaaaaattagccaggcacggtgacgggtgcctgtaatcccagctactcaggaagctgaggcaggaaaatcgcttgcacccaggaggtggaggtagcaatgaaccaagatcacaccattgcactccagcctgggggaaaagagcaaatctccatctcaaaaagaaaaaaacagaaacaaatcactttttaaacctattactagcaaaacatttaaaaacagaagctagaagtatgtgttgacacaatagcacattttatcagcccttattatgaaaattctgtgtcaattcccgtccacctgactttgaagttatcagcatgtgtagcaaaagtgaatatgtttcatggcctctttcccatgaacgtattcacattttatgaaataataaaattcgcataaagattacatcataaactccagtctccattttcccctcttcattgtatgcgacatacgcacgttccctgaaaataaaatgtgcgtgtaaaattaactggctattttaggttgagttcccagtgtacctatttggaatgcctttccaagtcaaaacaggttttgaggctgtaacaatagcatcacaaataaaacaagttggattcagagttttacctaaagtaattgggagtaaaaaaggaattgttcaaggttccccactatatcttcatacttcctttcgctggctcttgatttacttagagatgcagttaagatggaaatgagccatgcccagagggatggagaaggcagagtgagtgagttccggtgttgcttttatgaaccacgcaagtgctctttgcagaaacctggtccggaagccttcccccgtgtaggtgcggagaggagaaattgctcacagtctgaaggaatagcatgcacaagaacacattttcaaggggttctgctttcaaaactccacctttcgggaaaaatgtaaaaggtgctttgagatgaccttcactcttgtttattcccaatactccctcctccatccgtttcaatcattgcagctcagaactgcgttatgacagcagcctgaagaggaacccaggcctgccttataggacacccagcccatggcctgctcaatgaaaatacctggtaaaatgggcagcatggttctatgctaatgaaagctcgtgcccttaagtggctttctgtccctcatgtgggctgggtggcctgtctcccactgcgtgaagcctacagctctttacactgcccaactctgtttcttggtttagtttgactctgcagctacccttgggcatgccctggagtccggcagcctgggggtgctatgccatgtccaggctgcctcgtgtttaccatgatccccttggctgctttctttctttcattctaaatctcctggaagtttccagaagaaaagactgccaacttctcaccttggcaccctttctacctcttctgtttttgcattttacttttactttcaatatgcctctgcatctgtttagtaacaactaaaaagttttcctagctaggttatgactatctcaggctttgaagctctgttcttcttaccagccacatggttagggctgcctaactaacctttctgtgcctcagtttttttcatctggaagatggggatcccataataacattcgcctcctgtagggttgttgtgacaattaagtgagttttcacacaaataaggtttagagctgcacctggccatttgcaggtgctgagtgttagctgtagtttctttttctacacccccaactgttctgaaagacggtaagggctgtgagccctgacttggccgttatcagcaattttgacaatattgcattctttttccatggaaaaaactcgaataactcttacagatgagtttcaaagtcaatacaagatcatcactgtattctacagttccagacttgggtgcagtattggtgcctaagctggccaatttcctagccattggaggtgtgagtctcacggcactactttaatactttgatgctgagatgccaatagagaaagaaaatattgaaaagttgagaaactgattctgaatttggtttttatattttgataaaaatgaagagaaactaaaagaatttaaggagaccagtcttttaagaaatgttcaagtctactttttgttttgtctagggaagaaatgaagaccagttatacagcaactcccttttgtttttaggaagataattggatataattttgagaatgttccttggtttaacctcggggaagagttcagtgttattgttaaagaaaaaaaaatgacctttgataaggcagtaaggcagactttattcagagccatagagaccctgcaattgcattttgaagtgggcgagagagattgggcacaattccaaatacaaaaaacaaatgggagtttatagccaggtagtgaggtggggatcagtggatggaatattatttacaggagacatcaagggtaaggggcattctggctacatcacctgaacatgactcttgctgaacacagaccagggtgatcagacaaccacctgggggttggtgaaggagaaacctgatcagatagttagggtgatcagatacccaggatagccaaactaagcaggattcttgctaaaactggagaaggcagagacaagaaaaaatgctccaaagtcagggcttagttgagaagagcttagagaggggcctgcctaaagtctggtcagggaaagagtctgtcgtgatacacagttaagcacaagactcttggcagatgctatgagatccacctctccagggatggttgaaggaggctggcttggatttgggactctctgaaagggctctcactgtgaagacagcaggatgctgacaatacccacctgtgtccaccacagcatgcaggcctcatctacttctccacccacctgtgtctgccacagcatgcaggcctcatctccttctccccatgggtgcagcacagctggccagctttgaggttggggtcatctgtgggtctctgaccagagctcccacattccctaaatggaaaatgaaacctgagaattttctgtgctgcaccatctttgctagaatacttggctcaggaccaactatcaagaatatgagagaacaagtagtgtatcacagagatgtaagtgtcaatccttgttctggaatgttccctgcagtggggattcagcacagatcatggccacttatagccttgggaagtgagagcagagggttggggaagggcccccatgagcctttcaggtctagactctagtggattaataggagcagacatccccagctgccctctagagatagttctaatattttagtcaccatactacttcaccctgacatcaaaggacgtcttcaatatgcatctctttgataatctcccctcttgggtgaatttcagcctgtctcaattgggcctccaccttccttttcaaagaaaatgccttgttttttcctcttgttctataagatcttccatacccctatgctatatccgaggtctggtgctcaacttctgttctcagtaactactggcttttgtttctaactttcactacaattacaatcaacgcaagctttgggaagcctgcttttaccttgaagcacttccacatcaggaggtctgagtgcagaggtgctccttacaacagatggattgctgcacttaccggggaaaggccatcctgtgatgttcaccaaaactaacaaacacctggaaatgggaattgtgtttaatgaaaataaactgaagctggcttcgttcattatacccaaaatattagccatctctaatcttttcctcacaggttatgccctgcaggaattactgggagggatagagaagaatgctttcggttagtgaaagacaagctgtaattgttgggagcactggatgagaaaatgcacataaaatcacttggaaacttggattagcatgcaggacagataggttctgaagctcttcccagaattatcacactgcagcccctcagggtgggggtggggggaggggtgtcaccgtaaggtaatgaggcaggtgggaaggccacctgtcttggctcagagccactggggtgccatctgggtgcaattcaggcagggggtgactggccacctgtcctggctcagagccactggggtgcaatctgggtgcagttcaggcaggggtgaccatgttttctttaatgaagttatagcctatgctatgtgaaatacctggatgattccctaaaatcgactttaacagtgtttgcctatattagtcaactttagagtgttttataagtagttttccacttaatcacattcattattcttgattttttttctttttgtccctgtcactgaacatttgcatatgtagacaaaataaaatgctgtatatctcatagtgaaaccatgtaacatgcacacacgcacacacacacagggagagagagaaagagagaaaatggtgagccatgtatcaatgatcataactgactaaactggcaatgttaaactactgcgggttctacctctcaaagatcctgaatgtcacaggtggcaccatccgtagaaatggtaattcatcccgtcaattagctgtgatgctcaggaccaaatgttagcaaggctgggattaatagcaagtgatcatttgcatctggcattcaattgggagctgccatgagatgctcccaccctggggtctctgttctaaatatacgacaggctgatactttgcaggaaggttcattctcaaacataaatagcacacatggtctttgcattttgcctcccatcctagctggagaagcttattttgtatgtcatcctaaaggtcaactttctcacgctaaaaaagaaaatgggcatcaggcgaaggtgcagggagcgcagagaatgctcagtgcagcagctggtggttgtcctgtacctgcttcgtgcttgtctgtgtgttttgcccaaagtgatgtgggcccgaagttactgccaggatctgtctgtgccctagttttgcccaattctcacgtcaccaattctacgacccttatttcagattgaaattttttcatgtgagacccactacctgaagaaggcaaccctgcttacttactctagtaggaaaaggaatgctggttttctcagagtgaaactatttaaaatcttaccccttatttttccaaacacacccctcccacagtgctcctaacatgttttagttgacaattaaacgtctttgtgaattagtttttttgttccctgttccacatttcccctacccataaggcttacgtatttcctgtaaagcaagtacccttcttttaaaacaaagaaccatgaaattaagaaaggttttttggctggacacggtggctcatgcctgtaatcccaccactttgggaggccaaggcgggtggatcacctgaggtcaggagttcgagatcagcctggccaacatggtgaaaccccgtctttactaaaaatataaaaattaggcatggtggcatgcacctgtaattccagctacttgggaagctgaggcaggagaatcacttgaacctgggaggcggaggttgcagtgagctgagattgcaccactgcactccagactgaacaacagaaagagaccctgcctcaaaaaaaaaaaaaaagttgtttttttttttttttttttggaattgttgttttgtctttttaaaaacattagtgatggtgaccaaaacttggaacttggaagctgtcagttgggtgaggctttccaggctgtgttttctccatctgatgctcttctagcaagcattttctttcagtaaaactcccaggggaaaagaatgtgaaataactactttgtaaatgataccaagcctcaatgttaatgttcagtattgatattgaatgtctctcagcattttagttagttatgtgtcatcttcccttaggtttaagaatgtcatatatcagctatcctgttaaggatatgtatttaatcctttgaaaatatatatatatatacacacataccaaatacatataaaattgaaaggctctgttttatatttttatgtatggggaaaatggggagaatttcaacttactttgtaatcgggtcctaacagttcatgatttttaataagtagcaatcttaccagcagtgctttcccaccgtagatttaattagtctttcttcccccacccccaaccccttttgctagttgacggagctgagaggagggaaacggccgcaatttgaaaccttgttagaaatttatgaagtgctaaaatgttttattcccagaggctggcttgccagctgtcacgagctccctgcctgcctccgcggctgtgatagcaggggtaagagggaggctgccagagctgcacagggtggggaaatgccattcccatcagcagcacagggcggaggtcagctcctcgttctcctgcagctgaccagccacatgtgagatgagaattcaggggatctggagcgggcatcggagccctagagtaagaccctttgcggctgttgataacaggcactgatcgctgatcatgcaatgagacgtcagctttggttatagaaattaaacaaccattctgttggtggcctcaaacagataattggcctcttactagcaaaatgtccctgaactaattttttctggaggaaacaccttctcacaaatgttaccaggtgtgaaggatgttcttcccggggtcatagcctacctgcaatgactctctgtgtccccatccctcccccattgcttctatgatgcctggaatgtgtctctcaggaaacaaagtttaaaaaaattttttttctttggtccttgaatggaaatatcacttgcacactgtggtcatagataccccagagaataaacaattcataataaaggtgcaaatcacccacgttagatgctgagctggaggaagtgctaagtctgacatgatggagaccaaaaggccccacggaagcagaggaggaggaggaagtgcctcctccagggccaggggctgggccaggcagtgccttcatgatttgcctccaagttgctctgcgcaaggaattgggcatggaagaaggagccagagacctcagaaatcttcatggcaatgacattggttaggaaagtatgccctcagcaccctctcctacttcctctgcctctccaaaccaacaattatagtaagtacttttggttccacagaactttctgacaagttctttttttttttttctgtgatacatgtgcagaatgtgcaggtttgttacataggtacacatgtgccatggtggtttgctgcacctatcaacccatctcggttttaagccctgcatgcattgggcatttttcctaatgctctccctctccttgccctccaccccctgacaggccccggtgtgtgatgttcccctctctgtgcccctgtgttctcattgttcaactcccacttgtgagtgagaacatgtggtgtttggttttctgttcctgtgttagtttgctgaggatgatggtttccagcttcatccatgaccttgcaaaggacatgaactcattcatttttatggctgcatagtattccatggtgtatatgtgccatattttctttatccagtctatcattgatgggtatttgggttggttccaagtctttgctattgtaaataatgcagcaataaacatacatgtgcatgtgtctttatagtagaatgatttctaatcctttgggtatatacccagtaatgggattgctgggtcaaatggtgtttctggttctagatccttgaggaatcgccacactgtcttccataatggttgaactaatttacactcccaccaacagtgtgaaagtgttcctatttctctgcatcctcaccagcgtctgttgtttccagacttcttaatgatcaccattctaactggcttgagatggtatctcattgtgattttgatttgcatttctctaatgaccagtgatgatgagctttttttcatttttttttttttttggcggcataaatatcttcttttgagaagtgtctgctaatatacttgacccactttttgatggagttgtttgtttttttcttgtaaatttgtttaagttccctgtagatcctggatattagccctttgtcggatgggtagattgcaaaaaatttctcccattctgtaggttgcctgttcactctgataatagtttcttttgctgagctgaagctctttagttaattagattccatttgtcaattttggcttttgttgccattgcttttggtgttttactcatgaagtctttgcccatgccaatgtcctgaatgatattgcctaggttttcttttagggtttttatggttttaggttttacatgtaagtctttaatccatcttgagttaatttttatataaggtttaaggaaggagtccagtttcagttttctgcatatggctagccagttttcccagcaccatttattaaatagggaatcctttccccattgcttgttcttgtcacgttttccaaagatcagatggttgtagatgtgtgctgttatttctgaggcctctgttctgttccattggtctatatatctgttttgataccagaaccatgctgttttggttatggtagacttgtagtatattttgaaggcaggtagcatgatgcctccagctttgttctttttgtttagagttgtcttggctacacaggctcttttttgattccgtatgaaatttaaagtagttttctctagttctgtgaagaaagtcaatgttagcttgatgagaatagcatttaatctataaattattttgggcagtattgccattttcataatattgattcttcctatccatgagcatggaatgtttttccatttgtttgtgtcccctcttttttctttgagcagtggtttgtagttctccttgaagaggtcttatcgcatcccttgtaagttgtaattccaggtattttattctctttgtagcaattgtgaatgggagttcactcatgatttagttctctgcttgtctattattggtgtataggagtgcttgtgatttttacacattgattttgtatcctgagactttgttgaagttgtttatcagcttaaggagttttagggctgagatgatggggttttctaaatatacaatcatgtcgtctgcacacagagacaatctgacttcctctcttcctatttgaatgccctttatttatttctcttgcttgattgctctggccagaacttccaatgctatgttgaatagcagtggtgagagagggcatccttgtcttgtgccagttttcaaagggaacgcttccagcttttgcccattcagtatgatattggctatgggtttgtcataaacagctcttattattttgagatatgttccatcaagacctagtttattgagagtttttagcatgaaggtgttttgaattttatcagtccttttctgcatctgttgagataatcatgtattttttgtcattggttctgtttattgatttgtgtatgttgaatctgccttgcatcccagggatgaagctgacttgatcatggtggataagctttttgatgtgctgctggattcggtttgccagtattttactgaggatttttgcatcgatgttcatcagggatatcggcctgaaattttcttttcttgttgtgtctctgccaggttttggaatcaggatgatgctggcctcataaaatgagttagggaggagtccctttttttctattgtttgaaataatttcagaaggaacagtatcagctcctctttgtacctctggtagaatttggctgtgaatccgtctggtcctgggcttttttggttggtagactattgatttactgcctcaatttcagaacttgttattggtctattcagggattcatcttcttccttgtttagtcttgggagggtgtatgtgtccaggaatttgtccatttcttctagactttctagtttatgtgtgtagaggtgtttatagtattctcttatggtagtttgtatttctgtgggatcagtggtgatatcccctttatcatttttttattgtgtctatttgattctcctctcttttcttctttattagtctatctagtggtctatctattttgttaatcttttcaaaaaaccagctcctggattcattaattttttgaaggtgttttcatgtgtctaactccttcagttctgctctgatcttagttatttcttgtcttctgctaggttttgaattcgtttgctcttgcttctctagtttctttaactgtgatgttagggtgttgattttacttctttcccactttctgatgtaggcatttagtgctatacatttccctgtaaacactgccttagctgtgttccagatattctggtacactgtatctttgttctcatgggtttcaaagaacttggttatttctgccttaattttgttatttacccagtagtcattcaggagcaggttgttcagtttgcatgtagttgtgcggttttgatgctctacatgtttagagaaacttctctagtaatgaactatagaaatgatccctgaaagtactcttctgataagttcttttttaaaaaagtaaacgtaccagggcactctctaattgggatcgtttctctctgtattagtttgttagggctgttaagaaagcatcacaaactgagaggcttgaacaagagaagtttgctctgtcttgcagttctgtaggctccaagtccaagatgaaggtgtcaacagggttgttttttttctgagagctgtgagggaaagatctgttccagtcctctctccttagctggtggatgtctgtattcatgatcacatgatgttctccctgtagtacacatctgtgttcaaatataagatgagagatggaggggtggaggagagaaaaaaagagggagggcgggagggagagagagagagatgctatgttgttggctttgaaaatagagggggggccatgagccaggaaatacatgtagattctagaagctagaaaagataaggaaacagactctctcctaaaaacatttgataacaggtaccgagctgggagacttggagcagataagagctgtacttagatttagcaaaactgcatcttcgtgatgagccagactcaaggatgataaagtccactacttggaaggatcatggatgcagccttgggtttaacttgaagtcattcactgagttcagataccagactgactctttccataaggaattgcctggttaggtgagggtagaaattcaacaatgactgttgcattccagaagaaggaaggcaaagagccaaactccaagttgtgctttgggaatgttgtgattataagtaagtgcatcagctccaggctccccagtgtcacatgcacacactatggggactgatcgtgttgattctcagtgaggtgtcttggggaccctgtcccagctgggaaggtagggatgtattagaaggcttggtgccaggtgcagaaaggggaagattctggaggccaggcacagtccatgagctgtagccagagatatggcatgagaataacatctaacttcccagaaaaacagcacagccaagccaggcatcagtcaaggatcacaggaggagagatttgcaggaaagcaaggttcctctacctgggtggcaaaatgccacagctgctgaggcttccttgactcttgcctgcttgaaactggcaaagcagtgactgctggtggctatgaatgcttgttaaatggcccattcttactccctgactggcctgtgcccaggacctctgcagttggatagaaagacagtgtctctagggtaaggcaggtcagaatcaaacacaaattccactcagtatgacctgtggctcctgtgcaagctaacgtcaccctctcagcctcagtttcatgatgtaaaaaacaggaggaattctgaaatatttgaagcagctgtgaagcaagggccaattgaatcaataaatgtgaatgtggctgggcgtagtggctcctgcctttaatcccagcactttgggaggccatggtgggcagatcatgaggtcaagagattgagacaatcctggccaacgtggtgaaaccccgtctctctctactaaaaacaataaaaatgaaaaaaaatttcaaaaattagctgggtgtggtggcatgcacctgtagtcccagctactcgggaggctgaggctgaagagttgcttgaacctggggggtggaggttgcagtgagccaagatcctgccactgcattccagcctggttgcagagcaagactctgtctcataaataaataaataaataaataaataaataaataaataaataaataaataaatgtaaacgtatccaatacagctcctgattcttcatggaggcaaaaagatgaatgcccctctcgtcacctcccccttttgatgtgtggagggcgatggctgcattttcatctgggacagtgatggagatagaaggcggcagtgaggaaggaaaaggagggaagcaaagactggcaccccaggctgtgcaatgactgctgccaggggcaggctcatgggatgatggcaggagggatggggagctggctttgaagtcctggactgaagccagaatggttctcatgctcccgtagcaagtgctccgaggccagccccagcaatcaacccaactgagggcagcacagaagagtctggacagcccactccccgccgtattgatgtgcataattagcctgcaggtgcaccttgactgggggacagagagataggcaggccagctggcaggctgcccccagggatatgggtatttatccatgatcagaagggcacaagcgagtcacgtgcactttaaagatcattcagttggtttttttattcaggcttaaaaagatgtaatccagcctgaaaagattccaggggcaatgaggaattcaaagcagagccggctattaggtgaccatgatgcttggagaatgtgggggcaaggaggagtcctgatgcatggggtcatggagagtggtgggagtgagatgggcactcaggataggcttggagcacgtgggaggctgagagcctggggactgtggaatccaacctggaatcctcttggatggactgggagactcaatgccaagagatgagacaggatgggactaagagcaaaggccccaggctgggaggagctatgtgtcccttctctctacccttctctccctctcctttttgtgcctcctcactaccccatttcacaccccttccaggcagccttgtgcagtccggatccctgtactctaaggattgtcacaagcatacttgcgttctttatttatgatgatctattaacaagaataaatggttgtgggtcagataaagggctaaaaatcaaaagtcatccttaacatctttaagatgctactatgtatcatctgtcagggcatgagggtcttcatcaggcccactaaagaatcccatttctcttgaaccaagtgtgtcatgactgggaggaagacaagaccatttggggtgtgaagttttgggctagaggcccttttaggagccaggttagcccccagcttccccaagaaaccaagctgcccccctcatcctcgcctaagcaagcagctgatgacaaaaccggagttggcctgaggggttcaaaggaaaaccataaatagaccccccaaaataagaaaatcatgtaactaaattctttccactttatgccagcagtcaccacacctcctgtcctctgtatctcagttttaggtctttttttttttttttttgagacagagtcttgctctgtcgcccaggctggagtgcagtggcaccacctcggctcactgcaagctccgtctcccgggttcacgccattctcctgcctcagcctcccaagtagctgggactacaggcgcctgccacagttttaggtctttattctgtgttcctctttatttttttcccagtccctttttctgcatctctcagaatatacactaatgtcctaggacagccgtaacaaagtgccacacattgggtggcctaaaacaggaggaatttattttgccatagttctagaggccagaagtctaaagtcaaggtgtgagcacggtggtctccctctgaagctcctggtgggagtctgcttcgcctctctctgtggctgctggtggctgccttctcagtccctgttgtcatatctatcataccgtgttctccctgtgggtctgtgtctgcctctctgggtctttgtccagattttcctcttcttataagaaaaccagtcattgaattagagatcattgtaatccagtatgacctcatcttaatttgatgacatctacaaagttcttatttccaaataaggtcacatccacgggtactgggtgttaggacttgaacttaccttttagggggacacgattctgtccactgtgatggatatacgtgtattcccccacatgaaacagtactccacacatagggaggattcaatcgagacttgatgccaaaacttagtggcccaaagtggcaaacatttatgatttctcatgattctgtgggggcagctgtgcagctcttctagtaaggagaggcactctcttgattctcttaagtgtctgggcttcaaatcggatggcaggcacaactgggcctcagcacatgctctttaccctctggtggactagcctagcctagtactcgggtggtggacccatgtcccaggaagccacaatgctcatgcccttcccaactgcttgcatcacatctggcaatattcctgtgactaaagcaagttgcatggccaactccagattgaaggagtagagaagtcaggggagcagccaagtcacgttgcacaggacatgcatgaggaatgagagaatttgttgcagccattttttgcaaatagtctaccatagaagctgagtgacatgaccttttatatatgtggaagagtaacaatatatacacatgggctgggcacgatggcttacgcctgtaatcccagcactttgggaggccgagacgggtggatcacgaggtcaggagatcgagaccatcttggctaacatggtgaaaccccgtctctactaaaaatacaaaaaaaattagccgggcttggtggtgggcacctgtagtcccagctacttgggaggctaagcaggagaatggtgtgaaccccggaggtggagcttgcagtgagccgagatcatgccactgcactccagcctgggcaacagagcaagactccatctcaaaaaaataaaataaaaataaaaataaaatacacacacatacacacacacacacacacacacacacgaccatttgttgggcaatctttcttacaggctgaattgtaaatattccagagataaatcgcacagacttgggagttatatcgtctggcttgcaatactacctctaagatgtgcaaactgtatggcctttgaccaacctttctgtgcctcagcttcctcatttataaaacaagaataataatacctccctcctatggctgtgagttgtaggataaaagaagttaaaatatgaagtgtttagtacagtgtatttgtctattcttgcattgccataaagaaatgcctgggctgcgcgtggtggctcatgcctgtaatcccagcactttgggaggccgagatgggtggatcacttgaggtcagaaactcaagaccagcctgaccaacatgatgaaaccccatctgtgctaaaaatacaaaaattagctgggcattgtggcaggagcctgtaatcccagctacttgggaggctgaggcaggacaatcacttgaacctgggaggcagagattgcaatgaaccgagatcatgccaatgcactccagctagggtgacagagcaaaactctaactcaaacaaaaaaaaagagactgagtaatttataaagaaaagaggtttaattggctcactgttctgtaggctgtacaagaagcataatactggcatctgctcagcttctggggaggctgcaggaagcttagaatcatggcagaaggcaaagagggagcaggcagctcctatggccagagcgggaggaagagaggggggaggtgccacaaactttcaaataaccagatctcacaagaactcactcattatcgtgacagtaccaggaggatggcactaaaccattcatgagaaatccacccccatgattcagtcacctcccaccagaccccaccttcaacattggaaatgacatttcaacataagtttttggcagggccacatatccaaaccgtatcatacagtgacatgcataaagcaattactaaataagtgctatctgttttaatttaattcccaacttcttgcatcagatctgccaatattcctgtaactaaagccagttgcatggcgaacaccagattctaggagtagagaagtcaggggagcagcaaagtcacattgcaaaggacatgcatgaaggatgacagaatttattgcagccattttttgcaaatagtctgccatagaagctatatgaatatctcatttcaagatgtatgagcatctcattttgctcttaaattcacatcagtaaactttggaatcccctacacaactcgcctataccttggggggccagggtgctacctcagtcctgctctctgccttatctttttattgcagcattttcactctgctgtggcctctcagggtaggggagaccttccctttccttttctccactcctaccaatccagagtttctatcatctaaaccatacccaccctcaaatctaagattcctctcaagaatccaggcaacatctttttaaaaacttttttattttttatttattttttagcaggtggggacagagcctttttatgtcacccaggctgaaatgcaatgacatgatctcagctcactgcaaactctgcctcccgggttcaagcaattctactgcctcagccttctaagtagctgggattataggcatgcaccaccacgcccagctaatttttgtatttttagtagagacagtgtttcaccatgttggccaggctggccttgaactcctgacctcatgatccgcccacctctgcctcccaaagtgctgggattacaggcatgagccaccgtaactggaccctaggcaacatcttaacctcatccttatcccccaaatctctccatgtcctgcccactgcatcatctcccttcctcttccatgttgtgggaactctgtcctgagccatattctaagtcttcacaccatgtcttgtggcaaaactccatcattagacctccaagctttgttctgccttaatgcagaaggaggctttgggaatttagaaaactctcttccctctcaattgtcctataaatccagactttcaaatgaaatgcttaccatagacttgagaaacaaatcagaaactcagagcaaaaccctgagtctttattttaggctgtatctttctttgaagcaatggctgccatcaactccgtgtgtgaaggagacacaggacaattaagaaacaaaaatgagcggtggtgttgcaggtgctgttggtgcctgcctggagcctgtcacctccttaccatttcctggcagcacttccagctgcccagtagcaacacttcccctaaggactctctttggcaggtgaaagtgcctgagattgactcctgagagcagccacggccagtgacagccggaggtggtgatgtaaacctcagctagctaggctttcaggaagagtaactgaggcagggtcctgctctggttctcagtgtctccaagagatgaagctgccatttctcatagtggcgacttgctataatgtgcccttcattgaccgtcttccttttattgttcacttgcctcctttcctgcctgtgtttcctgaaaccaactacctcacataaactacttttgcttgaatccctgtcacagagtctccttctgggggattctgaaggtagacacatttaatatgtcaaaagtattgcacctgttgtgtgttttaggggagtgatgattagcagaaaatagaaaggaggctattatagtggtcctgggcatgggagaacaagagcaggtgctgataaaatcaggagaacttgaatagtggcagagctggcagaaacacggaggatgtgtcggagggtctggtgtgcggttgctccccacagcggagtctgagcaagaaaagaggctctggcctgatggcaagaagacctcacggctgtttcttgccattgctgtcactgtcatgttcataggttcactgcccatagcaactgaaagaatgtcaaatgcttgcacaacccccttcaatttgtagatgaaaactggaagtgtggacaggttaagtggaagctcaaggtcataaagccagccagctgcagaaccttgcactgtaagtttttgttcgtgacaaggcccagctccacttcaggtgcggttcagatttttgtcttcattcgttctataaaacttcattttttgctttttacttctcgactcttctaattgtcctttgtatgtctattaggtgtgggtcccccattaggctgatctgtagcataatttctacaataggaaagggagataaataggacatttaagatgcctggactcatctaaaggttgtttaaaagcaattactaccattagtttgaagcctacctctggctactctgatagtaatgtgcacccagcaatccaattagtttggaaatggattagtctatttgttaccaatgtgtgtggtttaaaatcagtataatatacatctaaaggtgtgtccattttatctattgacactttgtataaatgtgttgcttcatctttccgtaggtaatttactcactcccttctcccatactaaatgtttcttcattacaaattgatttcctaaactatgattcatgatgtttcagtttcattgtctttattaaatgactgtaattctttctttagttttaaggatttccattttgtgtcaccacattggactaaccatggacaaccagattttccatagaatgaggtcattttctgggaactaacagaccaaggaataccccctgatatactacattggaggaatccttgcagatactctctccaaatgtgttaaataaataaaatagtatgttcatcaagtacctctggggtaccagaagcacagataagctggtgtccaacatggagcaagtctggcattgaggtgttagaagaaaaaggctgggctccctgaactctgttacatggtggaggctgaggggcctgttgtgtagattcaggtgcaggccacgtgacagggtgttagccatgtaagtccatattttctcccattgcttcacatctatttcatctattacttcattcattcaacaaatgcttagtgtctattatttaaacgtttctggggatatactagtgaacaaaacacttgcctttcctccttgcttccctcttctccccttctctcctcctttccttccttttgtaattctttactccccgctttttaaaattgagcttattttcagggcttcctttgaacatctgcattcttatccagttttggaacactatttgtgttgttgttgttctgttggacagggtctttctccgatgcccaggctggagtacagtgatgtaatcatggctccctgtgacctcaaactcctgggctcaggtgctcctctcgcctcagccttctcagtatctaggattacaaacacaagtccctgcacccaatctataaaagtatttttttaaataactgcatattttatcacatattgcctcaaatcttgttggtcctcttgccaaattgtcagatattagtggagacacaggtcagtttcccaaggaaaagcattaaacgtggtccctgcctcttgctgcagcatttggctgcaggaatgtgtgtggattccaagccagagggagggccccacctcattaagccgacctaggggagggccccagctgtgctcagtcaggaggaagaggtgagctggctttggagaaaagaagaggttacagcagaaaggaagcacccattcttgacagagtcttagggagccttctctcctttctggatacaaagcttcacactataataaaaccatgtggcttatgtagttaattggtagattattattaccatgtacaaagtgctgtcaggagtgcaaaagaaaagatgacctgcactttattcttgttttgactcttcttggagttttgtctattgggatgtttgccatccagttgggctatagagctaacaatgaatagtgtgaatttgctgcacagtgagctggtaatgcagcagataagcagaacagaggcatcagatcagtggccgaggagatggggatggggtcatttatattatgaatattggattacaaggaggtgatgcactctgcttgcttcaatgattttttaaatgtaactttgtctttttttgtcttttaaaaatgtaacttaattttttttacacaaaatataaacatgaatagaaccccacttaagaaatagaaaagtgtccttgaaaaggcccctgtgtgctcctctccaatcacgtccccaccccaccctacagtaggaacccctctcctgaactccttgttaactaatcctcaatgttctttgtagttgtaccacatgtttgtagccttaagtaatattttgctaagatgtgcatgctcttgaactttatgtaattagaatcacagaggaagagttcttctgggactagctttgttctccacattattgctttgagatttatccatggtgatgtgtgtagtttgttcatttattcaacaaataaattttggaggcaaatactgagtgccacacatggtttctggctgctggggatacagtgtgaacaaaacaggcggaagccttcatcttaaggtagctttattctagtgggtgtgggagagcaatgcatcagataaatgaatatgtagactagtagattgtaattagtgcaaagaaactgaagcagtgaagaagagtaattttaagggagacgtggagtttcagataggctagagtcggtctcgctgagaaggggcacttgagtgaaacctaaacgaagtgatagagtcctggggatgtcagcgggggtggaagagggcttttcaggcagagcaaacagcaaacaccaaggcctgcagcagcctgtgtgacaagagcagggttagcaagggagggacaggaaggggagatagggacagagaggatgttggaggtttttgaacagggtggcattatatgacttatgctttaacaagatttatctggctattgtgttgagcatagagctgaaggggcatggggactggagcgagggctccaggtgggagtcattttagtcattctaacgagagatggtgtggacatggggaaaggagcagcgtgctgggtgcatcacaaaggctgagtgtaggattttctgataggttggatttgaggtgacagaaaaagtgagaaatcaaggactgtagcctgagcagttagaatggcagagggactgctcatcgagtgagggaaacagggcagggaaggaagatcaggggctcagtaaaaagaatgttcggtttctgatgcaaattcaacatcctggtgcagatgtgagcaggcagttgggtgtagaagtttggagtttagataagaggtctggatcagacatggaaattttgttgctgccagcctggagatgatactaaaaaccttcagaacgggtgagatcaaagggagaaagggagtgagtacaaagagactgggaaagaaagaaagtccagagactgtgttctgggatccttcaaaacgtagaaatcaggaagtaggaaccagcaacagagacttagaaaaagcagcaagaaaattcctatcagagggaaaccatgcatgatcaatagtgtcaattatcactgctacagcaaaacacaggccactggtgactgcaagagcatgttcagtggagtggaggggacaaaagccagcttaaaatgagagactaggaggctgagggagaaagtggagccaatgaggtcaggcatggtggctcatgcctgtaatcccagcacattgggaggctgagatgggtggatcacctcaggttgggagtttgagaccagcctggccaacatggtgaaactccatctctgctaaatatataaaaattagctgggtgtggtggcgggcacctgtaatcgcagctactcaggaggctgaggcaggagaatcacttgaacccaggaggtagaggatccagtgagctgagatcacaccactgcactccagcctgggtaacatgtctcaaaaaaggaaaaaaaaaaagaagaagaaagtggagccaatgaaggattagaggggagaggctacgtgggagaaataacaaggtttcagacagttacaggccgccctttatacattcctctgtaggtgcacatttaagtcagttccatctctcagcttctgtgaacagcgctgcagtaaacatggagtacagacatcccttcaacacactgatttcatttcctttagatctatatccagtaatgggactgctggctcatatgctatttctatttttaaatttttgaggatctttcatgcctctttccataatggctatacttatttacattctcaccaacagcgtggaagagctctcttttctccacatcctcaccagcatttgttaaattttttgtgtgtttttgatgataaccattctaaggtgaagggatatctcattgtggttttgatttgcatttccctgatgattagtgatgttgagcattttttcatatagctgttggccatttgtatgtcttcctttgaaaaatatctattcagatcttttgtccatttttaaatttaattatttgcttttttgatattgagttgtttgagttccttatatattatggatattaatcccttgtcagatgcatagtgcacaaatagttttttttccccattctgtaagttgtctcttcaatctgttatttcctttgctgtgcaaaagatttttaatttgatataattccatttgtctatttttgctcttgttgtctgtgcttttgaggttgtctttaaagaatccttgctccattccatgaagcatttcctctatgttttcttctagtagtttcatagttatggtcctaacacttaagcctctgatcttatttgagttgatttttgaatatggagatagtgatctagttacattcttctgcatgtggatatccagtttccgaggaccgtttattgaggatactgtcctttccccaatgagtacttctggtgcctttgttaaaaatcatttggatatacatacatatatttatttctaggttctgtattttgtcacattcatcaatgtatctgtttttacgccagtgtcatcctgttttggttactatagctatgcagtatattttcatcaggtagagtgatgcctgaagctttgttctttttgctgaagattcctttagctctccaggatcttttgcatttccatatgaattttaggattgttatttctattgcagtgaagaatgtcattgagatttttattatagagattgcattaaatctgtagatcactttggataatatgtatatttttaaacattatttcagtccatgaacatggaatatctttctaattttttgtgtcctcttcgatttctttcattggcgttttatagttttcattgtagggatttttcacctccttggttaagtttatttataggcattttatttataccttgtaactattgtacatggaattactttttcaatttcaatttcaaatagtttgctattggcatatagcaaacactactgatttttatatgttaattttatatcctacacctttaccaaattcatttattagttctaatattttttttttgatggagtctttaggcttttctctaaccatctatctaattatgatgatattgtctgcaaacagggaaaatttgactccctcttttcttaatttggatgccttttctttctttcccttgcctaattactctggacagaatcttcagtgctatgttgaacaaaagtggtgaatgtgggcatttttgtcttgttctacatcttagaaatgaagttttcaactgtttcctgctcagtatgatgttctctgtggatttgtcatatatggcctttattaaattaaggtgtgttgtttttataaccaatttctggaggatttttatgaaggaattgaattttatcaaatttttttcagcatctattgaaattatcatatggatttggccttgattctgttaatgtggtaatattatgtttattgatttgtgtatgttgaatcattcttgcatctctgtgatgaatcccacttgatcatggtgaattatctttttaatatattattgaattcagtttggtactattttcttgaggattttttgcatctgtattcatcaggaatattggcctatagcttccttttttgttgttgtattcttttctgatttttggatcagggtaatgctggcctcatagaatgagtttggaagtgttccctccttgtcaattttttggaagaattggtagaattcttgtgagaaagattagttgtaaatcttctttaaatgtttggtagaatttatcagtgataccattaagtcttgggagttttttgaatgggagattctttagtactgcctcaatatggttattcattattggtctattaagattttctatttcttcatgatttaatcttgctaggttgtgtctgtccaaaatttactcatttcttctagattttccaatttcttggcatatagaaatttacaataggctcttatggtcctttaaatttttgtagtatcagttttaatgtttcctttttcatccctgattttatttatttgagtcctttctctttttccttagtctagcttaaggtttgttgttttttttttatttaaacaaaaatacctccttgttttcttgatcttttgtattgtttttaaaacctctattttgtttatttctgctctgatttttgttatttttccccttctaatttggggttcagtttgtccttcttttctaatttcttgagttgtgacattggattttttatttgagatctctctacattttggatgtaggcatttatcacagtaaaattccctcttagaactgcttttactatatcccataggttttggtatgttgtgtgcatattttcatttgatcgagaaatttttaaattttatttttgatttcttcactaactcctctgttgctcaggagcgtgttgcttaatttccatgaagttttacagttttgaacatttcttctgttattgatttttagttttattccatggtggtcagaaaagacacatatgattttgatttttaaaaaatttctaagacttgttttgtgactttcataatctatcctggagaaaatatcatgtcttgttgagaaaaatgtgtattctgaatctattgggtggaaagttctgtaaatgtctgttggattcatttgatctagaaggctgtttaaatccaacgtctctttgttggttttctgtctggataacctttccattgctgaaagtaggggtattaaagttccctactcttattgtattatagtcaatctacagacctttcagatctattaatgttttccttacatatttgagggtctcaaatattgagagtcccagttttgggtgcatacatatttacaattgtaatgttctctttctgtattgatccctttgtcattatatcatggtctttttgtttattttttaccattcttgacctaaagtctattttatctgatataaatattgttattcctgctttttttttttgcttcaatttgtttggaatatcttttttccatctctttagtctgtgcatgtttttataggtgaaagatctcttgtagacagcatataattgggcatttttaaaaatccattcagtcactctatgtctcttaattggagattttaattcatttgcatttaaggttattattgttaggtggggctttactactaccattttgttacttgttttctggttgttttatagatcctttctaccttgtttcatctcttattgttttccttgagagattttttttttctagtagtatgttttgatttcatgctcattatttttagtgtatctattataagtttttgctttgtaaataccatgatgcttaaaatcatgttatagttaaaacaagttatcttaaactgattaacaacttaactttgactgcaaattaaagcaagaaaaacaaactacatttaacaccatcccacacacgttcatttttatttttgatgtttcaatttacatctttttatattaactcttaactaattgttgtaattactatctttaataattgtttctttagtcttcatacttaagatccaagtggtttacgttccacaattacaatattatagtattctaaatttgtctgtattcttacttttaccagtgaattttataccgttagatcttttcttgttacaaattagcacccttttctttcagatgaagaactcttgtcagcatttcttgtaagacagatctgatgttgatgaatttcctcagcttttccttgtctgggaaagtctttatctctccattgtgtttgaaggatacattttccatgtgaactattcttggctacaaggttctttcccttcagcactttgaatatatcatcccaatctcttctggcctgcagtgtatctgttgagaaatctgctgaaacttgcactggggctcaggtgaatgtgatatgttttctttctcttgctgctttgagtatttcttctttatctttgctttttgataatttgatgctgtgccttggttaatttctctttgggttgaatttgattggtgatctctgagctttttatacttggatactgtcctttttctccagatttaggaatatcttagcgattatttccttaaacatgctttctagaactttttctcttttatctcctggggaactactattatatagaggttagtttgcctgatagtatctcataattctcataggccttcttcaatctttttttaaagatttttctcctctgattgggtaattttatatgttctgtctttgaggttgtgggttctttaagtctgctattgaagatttcgaataagcttttcataaatttcaataagttcagttattgtattctttattcttaggatttctatttggatttttaaaaagtgtttctatttacttgctaaatttctcaaattctttcaaaatttcactgcattttccatccacattttcttgtgactccctgaaattaaagaggattattctgaattctttctcagacatttgatagatatttaattcttctgggtccattattggagttttgtttgtttcttttggtggcatcatatttccctgagattgtttttgttgttgttttgttttttttaaacaatttttgcgtgttttatgatgatgcctgcatatttgaagagaaagccactcttccagcttctgctggtgttattagtgttggacctctactacttgatattgggacttaatcactgccctgccattgtttcccagtctagggaacacttatagtgagcactggaacttaaacactggactagaactaaattgctactctactattgtttcctggtctgggaaagacttaaatacgtactggaacttaatttccaaaggaacttaatttccaaactcagttgtttccaggtcaggggaagactccacatgagcacctgagctttgtgggaagtctggccagagattcagaccttcctgccgatcatgcttcctgcagcactatagtgctggccggtctcctcagtatgacatctgcatccctgctgattggagctccaagattccagcaccaagtgatcagcacccccactttttgtccccagttcaccccaggtagttcagccctcctagctctcccaggggttcctgtgcagtgagacctgagtgggcttcccatgaagattcccatactggtagggggatcaaacatccacctccaattccatcttcccaccttagaaaccatgagtctgtgtcaattctctgtgagtggcattatacaagcctggagaagagagtggcacagtctgaaatgaccatttttcttagttattatggcctagtgggtttctccacttctccccaagttctggtgaattcatggtggtattcttgtcttttaatagtttccagttgtatgtttgtggaggaaataatgtcagggtgtcttctattctgcaatcttgctcatgtttctccttcataattactgttactttttatagaattgtatttagatctattggtcagcagatttgattataagaaattttgacctatttacatcatgagaacaaagaaaaattttgagaaatgatagggagaattcctcagatcaaggacttgtgaaagatcctgagaactgttgaccagacagaaacatggtatcagaataactctcttgtatcacaaaatttttttttaaatgtacttctttatctcaaattttaattttttaaaatatacatttgattgtttttttcttctagtataagcagatcctcactgcatgttttggggtgtgaaattcgacatctctagcaggttaacctcttgtattatgtcagagtggggaataagctcagaaaaatataatttatggagaacattttctcattttctgggaccttgtaaagaccttatttgttccaggtgacaggccccaagtggaataaaaggccattattgtgagaaatgacaactcagatatagcaaagttgttgccaggagttgatgatgcagaaacaatttattttgggcaagatggtattgaatggggagtctattagtggtattttaccatgtgaatttctatatgaaccatgtctgtgggagcactgctgcattcatttgtgggatgtactgctttttgctagttgccgtcaataaaatctgttctgtagctcttcaaagtggttgattcagccactctgtattcaggccataaagatcatgaaatgaaagtcttctgagctccaattagagtggaatgttatatctcaatgcagaagtcttcttcagtaaagtaagtgtaagtataaatttgtttagtgaaaagtaccttttggaaattgtacttttgagacagaggcattcaaactctgactaccgcttgccaggtgggtaatttaggggatactgcttaacttttttgataattgtatttcctcatctttaaaataaaaataatgatgaaaatgttaattaaaaggatgatgatgatattgacaataatggcaatgatgatcatgacagtgaagatggcaataacagtaacaatgaatctggtgatgatgatgacaatctcaaacaactgttgtaaggataggacgtaatccattcaaagtaaccagcacagaccctggcccactaaagggagatcattaaatttcagctgcccttaactgctttctcaaacctctactctgttttctggattttctttatttgtgtatatgtatcagttttatattgctgctgtcacaaattatcacaaacgtagtggcttaaaacaacatacatttattctcttgcaactctgaaggacagaagtacaaaatcactttcactggatgaaaatcagtgtgtcagtaggaccatgtcctttcagagtctgtagaagagaacccattcccttggcttctccagccctacagtggtgctcctcatattccttggctcctgacccctttctccatctttaaacaaattcattaaagttgcaggatacaaaaatcaacatacaaaaattagttgcatgtctatgagctacaccaataatgagctaccagaaaaagaaattgggaaatgagctgcatagtgaagtaatcagaaatcaattcactgtccttagttctgctgggacctcctgttcaggatttggcagtaccagtgacaaaggctaaagctgcttggaattatatattctccatcttaaaatgccaaggttaccttggacttcaacctcagatgtcgcatgtgactgtctaggttgtacataaagatacgaagggtgcccattgaagttggccagtgcacaacttgtgtggctgtacgtggtgggctttttctgatgcccaccagactaaaaactctagaaatgtgtgatctctatctatcttgtattctcagcacctactgcagttcttggcatacagtagaaattctcatttaaggaaatgaaggaatgaacatataggaatagtcaatacaagaacactaagtaacacctcatctggagttactcaggtcagtatactgagctgctcattcgaatcacctggtggaaattttaaaaaataaaaatctcagcccagatcctattgacagacattctgatttatttcatctggatggggctgcagtattactgcttttctaagaagtatccaggtgaatctaccgtgcagccaggtagctagaacctgctagtctggaagagtggttctcagacttcatgcattaaatttacccagtggacttgttaaacacacaggtgacttttcttactctgtcactctgagtttgggggctgagatattgcatttctagtaatcactcaggtaaggctgatgttgttggtatggggaaccatggtttgagaactgctattcaggaagacagcagagaagataagttcctttagtgtgcataggtggaaaacagttggtagagtgattctggaagagtgcatgcatgtgcattcacatgttttattaacatgtgaatatgaaagatattaagcacccatttgtccattttaaatatataattgtatcccttctgtccaacagcatttcactgtagacatttttaagtgtcagttttttagctgaaaaactagaaaaccaaggaagtaaatcattgcccaagctagacttgatcttttcagcatgtcagagtctcatgctttagaaaaccagagaccactctcactattttgtgttcatcctctttctccatttccagtcactttttctgcactgacttcaggttaatcttccataagagggccttggtgttctcatcttattcctatgcccccactaaattctgagtaagtgtaacagcctttgtccttctgcatgccacacagtagttacctagctaagatattgtcaatcagtttgagagactataagctgcctaacctagagttggaggataataccaatctgagatcttctgagcttagcatcattatcaacttctgttacttccactaaaacctttgtaaatcacagcagatatatttcagaactgtgccacttatctcagtgcctccaggcatttcaaagtagtcacttcacacttgccatcctccctgtccttctgagtcctcctctcagccccagtgtgtctaccacctcaaagcctatggttgttagcctgccttacttgggtcaaagaccttgactccttccagatggatcctaaacttcccttccattcactttatccaaaatgaaattgtacattcttgaaatacacagcagcactcaacaaatgctgaaaattatatgattaaagtaatttgcactcaaatgtaaataaggcttgatgctccatggaagttttgaattttaaagaagagctttttattcccaatggctctaatgtgtgggaaacatattgggggaggaggcacatggggtcagcaaatgctgtggacaattctctgccctctttacctgggctgccgttagtttgtctggcagggactgaatatatggctttaatattctggccaaactatctcctcatctccccttagctttgcaaagtggctgcagtaaaacctgccatgcttggattggcacggctcaaagctaactgtatttgaaacttcacatttcaaatctcgaagaagacttctgtattaaatttagagttttttatcctcaaaggagttgtacattttatttgtgtcaaaatttacagagcactgtcttaggcgctttctagcagttgctttaaagggttgtcagctccaggcatttcctctgcccacatacaggtgttgtcacatgttcccaggtgaggagttagcaagggtttgctgtagctcttggtttaaatgttggcaaaaaaaaaaaaaaaaaaaaaaaaaaaaaaaattacacctgcatcatctagaggtggcctttcccaatggacatttccacttgtgatgatggactgaatattgaaaatcatttctggaaactgtaaagtgaaagaagccactgacactgaactgcctgccagaatcaggagataatttcttttctgggggaaaaaaaaaaaaaaactaattctctaagttttaactgatttcgggaagttaaaactacagtttatccccagggttatgggccaaactgtacttttaaaaaaattatatgttgaattcctaacccccagtacctcgggatgtgactggatttggagatagagtctttaacgaggtgatgaagttaaaataatgtcattaagtttggctctaatgcagtctgactggcatccttataagaagaggagattaggacaaagactcacacagagggatagccctgtgaagacacaggaaagagagaggccccaggaagagccaatcctgcagacaacttggtcctggacttctagcatctaggactgtgagaactaaatttcagttgtttaagccactcatctgtagtgctttgttatggcagccccagcaacaagaaagttgttgtcaaagaatacatccttttgctggaccagcctctctggggctgccccttccctgagcaggtggatttctctgtccgactcctcaagggcatggcccccacctccccccagcattgctgcagacagtgctcctgccattgtcctcttgtcgcctgtctaggtttggttgtccttgttctttcctctttgcctatggctgaaattaagaatggtgacaagataagactataatcctctcctttagtctcagtacaaataataccacattaaaatctggagaaaaggaacatgatgatccatgggaaggacagccagctctgtaaaagcatcactggacgctagcagaaatggtgcactccccaccagaactcatgctcccccttcttcctgcagggttggagctgggaagcagctgcccagacacaggctgtggtttccatccctctccttgttggggattgtccgtgtgactcgcccctgctgagggatggcgagttgaagtgatgcaccttccaagccttggtagtgaagcaggaagtgtgtttctctgcattctctgctatctggttctaggactttgcttctccaagtgtggtcccctgactggcagcatcaacgtcactcgatgatttgtgagatgcgcaaaacctggggcccattcctgacctactgaatcagattctctggggtggggccccgcaatctgtctttgaacaatcactctaggtgattctaattgacctccactttgaaaaacactgggatagaggacatgagaggtctccaaaaggcaagaaccaaggttcctgaattgttgtgtagaggaagggcacccaccaatcatgaacactactggggtgaccttcatgtgactcctaagcaagatgtaaatgcctgttagcttggaccactgaaattctggggtttatttgttacaacagttaggattgtccttaatgaagggcagaagaagatgcgattacaattaagtggttacagaaccagctctgggtccctgatgcaactctttcccactgtttgctttaggaaaagagcaagagttagaatttcatgcattggcatggtctacctgcaacctgttgtgcattttaatttaatttagtttcttggtaaaatttttaaaaccttatttggtaacctctcaaaagcaagaaactaattgttcttctgatgtaaaatatcaagcaaatacaatcaactattgctacttacggggagggggtacataacagagcagacccttctctttgccaagactgtcgtgaaatgcatttcacatgaatgaaacatatgcctcccactagtaggagccacagcatcccttgaaggctatcactcccctgaaatgagagctacctctcagactaaagtgtggtcagaaagggagacttgaatgggaggatcattttattgactgtgccttcagaaaaagaaggtggtttctgcatgacaggaggtaaggctgcacctcaccttgatatgggctggaagactgggagcccagaacccactcaagagccccttctgaggtcagctggatgctggatgtggccaggctctggaaagccagcagagaatgagatgctctttctgcctgcggagattgtgttcctctccctgtggcttagtgtcatcagccctataatcacctgatagtcatgacacatgaacccagacaggttgctgagtgtttttgagatggagttttgctcttttgcctaggctggagttaagtggtgcaatctcggctcactgcaacctttgcccccttggttcaagtgattctcctgcctcagcctcccgagtagctgggattataggcacctgccactatgcccagctaatttttgtattttttttagtagagatggggattcaccatgttggccaggctggtatcaaactcctgacctcaggtgatccacctgcttcggcctcctaaaatgctggcattacaggcgtgagccactgtccggccggttgctgagtttttaaaagcaaacctctccagtaactgggtaaaatgttgatgtatttccttataaagctgtgtgtctctattttttatatatatacacttgtgatcctataatatgtatcatttctgccttacagtgaaattaaagcctgccttttattttataaccaagagtcagaattcaagaaattcactagtaaagcaatccattagtaaaaataagaaattagaataaaggaaaatattgtctattgtcctaactcccataattctagaatcttccttacagtatttgttccgtagcatcaacttgctttctgattgaaatcactgtgtgactgtaattttgctttctgcttaacattttatcttaagtattttctatagtgtttcacggtctttttaaatgtaatttttgatccataatattccataaaactaaagttccacaataaactatcttcttcttgtggagtagttatataattttcaattctataagggtttttaagtaaaattaaaaagaataacttggtgcaaaaaaaaccctatgctatttaagattgtaacttcagtatatgttatagaagaaagaagcttgggcttgacaatctgtgacatcatagaaagatatttggtctttgtccctggttcttgacacaggagctcctaaaacccttgagatgtcctgaatgacaagtgtgaaggaagcctcttttgttctaatgaggtggttggaggccctagataccttcaggatggggggctgcacaccaaaaagaccaagtcacagtgacagggttggtcacaattggggaagcctcagaagaaatcaaccctgtggatactgtgatcttgaacttctaacctccagaaccatgacaagatacatttctgttgtttgagctgcccagcctgtgatatttcgttacagccctagcaaactaatatacccacggcccccatgagcttaccccctgacttttggagagagaagaggagctggaagttgagttcagttaccaatggccaatgatgtcatcaatcaagcctatgtaatagaaccaccagaaagccccctaaatgatgggcttcagaggagagctcctgggtgggtaaatatccttgagtgaagagagggtgatgcgtccagggagggagtaggggctctgtgtccctttccccataccttgccctatgcatctctcctcacatttggctatttctgagttacatcctttatttgaaactgataatactaagtaaagtgatttcctgagttttgtgagcagttctagcaaattatgaaaactgaaaggggagattcataggttccccttgactttgtattcaagttggactgaagtgtgggtagcctggggatgagctacttgcacctggcatcagaagtgagggcaatctcggggaatggagcccttaagctgggggtggggaagtctgcactacctctgggtagtgagtgtcagaactgatctgaaatgtaggatatgcatttgctcttccagagagaattggttggtgtgagaaaaaagtctgcccatttggtatcagaaatgctgtaaataaaaaatagtgcagaatgcaacagatttgggtttgaatcatgactctgtcactttctagccatgtggcctttgtgatctttcatacattagttaatatctgtcctccttcttaaaataggactaatctctaccctataaggtgctggtggttgttctttgagggctaaaggatgcaatgacatttcaaatctcttagcacagtgtgtctggaatgtaggtgggtactgcacaaatggtaaatatttgtattacaaaataggcccccaaaagtggaaatactgggcaagagtttgcagcctttttttgggatcttgacacctatagccaacttgctttctaaaacatgcacacactcatttcagatgaaagcaagtgtgttttaaacactgtggcagtttgtaacagttccttaattgctgtaaattgtatacgttccttaactagttgtatttcctccttgctacttgcctgctcatgtatcttttgaatggaatttaattcagtaaacacaaatagtcatctagcttgtatcagtgccgtactaggtgttagaaatgcaagcataataggatgcagtacttacccatttggaactttaaatcaactggaggagaaaaacacgtggatcagtaccctcagtgtgatacatgcaaataacatatatgtacaggcaaagagaacagagagtaatgaattcctttgctaatttatctctcaatgctttagcaattttttaaaaattcatttgtgaatagttgaccagtttaaatattgaaccaaccagcatttctgttttgtgacaataacaagtcaaaatccaagattctcttcttactttgtctactctcttctcttccaaaagcacattcacgtttgtctacataaatacatgagaacattcagaacccaagaaggtggactgacaaagctgagggacggtagagactgcacgtattaaacaagcaggaaaacaaccctcagagtctacattttcatacaacattagaaggaaaaaagggtattaactgaaaagaagggtgtggaaatcaagtgtgaacgagccatattgaaactctggctggaatggtgggatggaggtcccagttgaatttttcctaagaggctgcttggtaaacattatctgtagacctctccgacaattggatttacattcgaagaagcagattgaggctcaccctgatagaagaaagtgcagtgatttacacaggttggatggaagacctttctgtcctttgtgtatgcatggcttgactctaagctctggcccctttgtctcttaaagaggcctttctcaaggtggctcttgaatatttttaaaagtatttttcaaggctccctgcatccaagcatggcacccatgtgctgtgggtccttctctccctctggcccatgagtgacttatctgagagatgggtttgggaagaggaagcagcgtgccccttttcttatcttcctcctgctctcctcttgtagccccgtagcttgatctctgtagatgctgttaaagtggaaagcttcaggtgaaaatttccttggattggagactctcagtgtcatcttttgacaacatttagcgtttcttggggtgactccgatttctagatgaccccacatcgcatctaatgcacatctaagttaatcctcacagggcttactctgcttatcatttattaaggactgacatttgtataattaagttagggcccatcatctgtttaagattcaacagtaagtgatgtcggggtttacggatgccaagacaccccagctccctgcctatatttggaatcaattaacagaaagatatagagaggggtcaggtggagatcaaatatcatctgtttatgacaaagtctgagcttgacaatgtggtgctgacgggtggcagcaatggccttgctaatcctaaaccccagaaccaaaccaagccaggcccctggagcccttcccccaaccacaagcagggtcttgctgcaacttaacatggggagagtggagcagagcagagcagtgggcatggcccctgaggtcaaggaggctagaggggagaagaaaaggaggcgtgtcactttctcttcccaaactcacctctctgataagtcactcatgggccagagggagagcaggacccacagtctatgggtgccatgctcagaggcaaggtttctcagcagcggcctattgacattttgggttggatggttcttcaatgggagggactgtcccacacacagtgggatgtttggccacatccctggcctctactcattagatggcatagcactccccaaaccctccctcatgacaatcaacagtatctccaaacattgctaattttccctagggagggcaaaattacccccagtggagtaattccgcttctccaatgtgaggtctcaccaaaaagtagactgggagtagggaattgaaaccgcaaaagaaactgcaggcagcaacctcctcagtcccatcagtcagtatccagcaggctcctctgttctttccaagctcctggttcatacctcccctggcacttgtctccagcctgcctccctgtaagtgcctctccagtgggttatttacgagtgcagcaactacctggccttttgcccctccagcacctgcatgcatgtctgcaccctcccagtgcctggcacagtttgccatacctggggcctcttttgtataggtcaggaaggtaatgattttagagaaagtttctcagatacaggaagaaaaaaatagatgagagtattttcccatattaatctttaactgtcgctgtaattgcctcaaatcactttatgcatcgtctgacctgccaatcacatggatcttacccagcatagaaaagcagagactctgaaatagtagaaaaaatagcaagtgatcatcatatccgtggtgctggctccaagcccaggactcgcacaaagtaccattaaatggtgataatagtcacatatattgctttcttcacattttaagtcctctcaaaaagtgtttcatattcatcatttgtatgcatttgtcttggattcaggctagacttttctagttttatgatacaagtagctaattaggactagtataggggcaaaagtaacttattttgcaaagcatgctcacttgaaattgcctcaataattgtatgagctattttaggaatcagagctaatgtgtgattaattagaggaccttgtccacatcagtcaggcaaggagcctccaaggagatgaagttattgaatcagtgtatctcctctaaggcagagaaacatgcattcttcttgtgatttcatgactcttaattggaatgagtaagagactagatattgctgagtcaaccttcaaggttcttggcatctccaatacaccattctccttgaaaacatttcagtatgttcaatgttgggcagttctaattgttagaatgttctgccttacatggtggtggcatctgcctctctttaacttcattcttaaaggaagggagggtcctagggtgatataatagatttcatcctcctgcccacagcagtcattgcagaatcttcagaattctatcacatttgtcccatattatggtccctggttcctctaccatccttgtttccctctgttaggggttgaatggtatcccccaaaaactatgttgaagccttaaccactgacctcagaaggtgattgtatgtggagatggggcttttaaagaggtaattaagcaggcctggtgtggtggctcctgcctgtaatcccagcactttaggaggccaaagcaggtggatcatgaggtcaggagtttgagaccagccgggccaacgtgataaaaccctgtctctactaaaaatacaaaaaattagccagatgtggtgcacacctgtaatcccatctgctcaggaggctgaggcaggagaatcacttgaacccgggaggcagaggttgcagtgagctgagatcgcaccattgcactccagcctgggtgaaagagcaagactctcacccggggggcgggggggggggtgcagtgggaaggaggtaattaagttaaaatgtggcctgtaagatgggccttcattaaatatgactgatatccttataagaagaggaaattaggacacacacacaaaggggaatgtgaacatacattgagaagacactttctacaaaccaaggagagaagcctcagaacaaaccaaccctgtggatactgcaaacttgaacttctaacctccagaaccatgaaaaaaaatatttctgttgtttaagccacctggcttatggtattttgttacagaagccctagcaaactagtatactcaccgccccatgagctatagcctcaactttcccctccttatcatgaggaccatgattgcaactgccttgtgggttgatggggaattccatgagatcatgcagtgtctgtcctggtatttagtgaaattgtcttcttgttaacattattctcactatcactcctatcatactacctgtgtttaagtgactaatgaaaacattaaatacaacaaagttaatactagcctaattttgtgttacttcagaatctgtaaggttgactttgacccattcctaaatacttcttcagaacagtcatgcttatggctcacatccttattaccaaaccttccttaccgaagctcatatttgttgcctctgacattctagtttactggcctcatactttaaaagtatgagagaaacaataaatatgtaaattattttgtttttaaatgcatagagttggtccaaatatgcaaacataaaaataggtctttaggtagtgacttggggtcataggtttactttctatgggctaaacatttttctgatggtaacaggatcattccataatattttgtaacaatttctgttttgggctttagtaatcattgagcaagttgcatgtgctatattgttaacattgtactctaggtgccccaaaatatgcaaatactctaaatctactgatttgaaatctggggtattgtgagtccggggtcttgctcccaccccctcctctcttgcagtttgtgttgccttggcaacagtcttccagcacatcacatcaggtggcctcttatagagacagcatcatgggctggacagcgtgccaggcttgtggccctggggcatccttgatagatgctatgggcgttattttctgcttataaaatcttagaacagttatgtctttacagataagatttgatttttatcaaacggtggaaaatgctgtgactggcacggtcttcacactctctcttggaaatctgcgatcctgggtcggtttaatttaaaacattccagtaataactttcagactttacaactcaattttattttgagaagtcatcatgaaggaaatatttaagaagtctcattcctttaagtttaaaaatgttccacaggattcatttgcaacagccagccactcaccccaaccccaaacttccagaaaaaattatgcctccaggacatttctccaaatgaagtgtcaagtccaaatcaagtcaaatttccaatgtggaataatggactctattttatgacctcctgcgccccggaggctcttcggagcccattacacagctggtgcatattaggtatagaaggaaagagacctgagtggctacgggtttctgctcggtgaagcccaagccacatttcataggttctgggattattaatggtatgtctagttgccttgagaatgttcaactccagtctgttatgaatacttaatagcaaggagaatgtgattcttctcttttcagagacgtttctgtgactcggcgaattcattctagtgtgataggcaaactgtcaaaattaatgaattccaactgagatttggttgtagtgcagttgtaaattagcattaataccacagtgtatgttgaatgtgctacattttcaccatggatctggcctagaggatgtctttggaggaagccactctaaaaatcatgttttctggtttggttttttcaatttttgatcatagttttaattctggaagaagtatatgaaagtaggtcattaagattttatagaacacaacaaaaaaagaaacaggaaataaatgttataaccaaagacatgttagcagagttgtcttgtttttgtgtggctgtgacttaaagatctgattactgaacctcaatctatctaaatgttaagtgattacaaaggaacacgattcagtttataaggctttagatgagctccaaggactacacggcatacctagcccaagcacatcttattatgagaattttaaataatctgcagcaatgtttagatcaaaggtgttttaagtggggatttggacctttaaggagctggaaacagaactgtgtgtgtcctttttgttcatgacagagtgcagcactttcttctcattcttaaagggttctgagcccaaacacagtcactgcttaactgacaacctagcaccaaatcccagctctgttcctcacgacagagttcaaagtttatatggtttctcatctctgacataaaaatagcagcaatagcagcctgtgaggtgtagtttgaggattaaaataaggttttgtatttagattacttagcataatcctagcacataatgtgtattccataaaagctaattatttaatcatgccaagaacagaagcaatagttacagctttgaatataaagtttgataatgcacttggtgatattttcttggcagacacggggctagcgacccatgtcagtggagattgaaatattgccacgtgtagatgcattaccactgagtgaaggagcacacttgggcatcttggtgctttgctgacacacaatacggaatccagggtaactaatttccttctcttctctagagctctgacttctcacctagtgcagtctgtaagaataaacatctataggattaaatgtgacaatgatgggtgaaaatgcttgggaagggcctaaggtgctgtgcaaatggagaggcggcattcagaatcatttgtagtgggctaggcatggtggctcatgcctgtaatcccagcactttgggaggctgaggcaggtggatcacctgaggtcaggagttcgagaccagcctggccaacatgataaaaccccgtctctactaaaaatacaaaaaattagccgggcgtggttgtaggtgcctgtaatcccagctactcaggaggctgaggcaggagatttgcttgaacccgggagacggaggttgcagtgagtcaagattgcaccactgccctccagcctgggcaacaagagcaaaagttgtctcaaaataaaaaaaaaaaagaatcatttatagtgaatgtttaattttaaaacactatatgtcactgagacttattgatatttaattgaatttagcctaacagtcttgtgttcaagaagtattaaatatttgttgagactctttgctacatgctagaaactattgtaggaattgggaatacatcagggaataaaatcaaccaaaatatttactttttagggaccaaaattttaggataggtttagaggcagacagttgaagcaagtataacaaataggtaaatgatcgagtgcactaaagacgctgagggccatggggagtaagtgcaggcgtgggtcggagggggcgctgcagtagtggaagtgccgccatctttaccaggcagtcaggggaagcatccctgagggggagacggcacagccaaggctggaaaaggtgagccagggagtttctgggagaaaaacatcccaggtggagggagagcaggtacagagacccagaggtgggagcctgcaggggtggtctagagacgacaaggaggccagtgtggctgcggtgggatccccaggggagggtggtaggagatgacatcagagaagaaacagtgaggatggatcctgtaggaagataggcttttacctggagaatggggtcctcaaaagctcagaacagaggccagagatggcctgagccatcttaactggatcactctcactgatggagctgatggatgagagtgtgtgtgtaggggaccagggtagaagcagagagacccattgggcaccagggagaggtgatggtggattggaccagggagtggcagaggagatggcacaaggcagatgcagggtatattttgagggtacagctaagagacttattgatgctgtgaatataagatatgaggaaaacagggacctctacaagcacccacatgtttgggttgggcaactgttaagaatgatgctttttacttcttcgattaaaactctcatattttaaggatatttttgagtataccttatgtgactcttattaatttttttctgaagtactaacaaatgtgcagaagaatcacatacatgaggaggaaggcaagaaaacttcttgaagttttaagaatactggatcccagaacaggggcatagctaagtggacaaggaaattaggacaataatttaaccagggttccaatcaacagattttttaaagtcttgcgtgtttgagactcctaaataagcctctgtaggcgagatttcagcatcgtgtgttttccatcattgagagcctgtggggcgtcattagtctccagctgactgatgtaggtgagaatgtcttattttgttttttgttgtttgtaacagaatgcctgacactggtattatagagaaatgatatattgatttcctccaattatggaggctaagaagtccaaggttgaagggccacatttggtgagggtctttttgctgatggggactcagagaagagggggctgggtatgccagctcagatctctcctcctcttcttataaagtcaccagtcccacttccatgacaacccacccactaatcaattaatccattactccatcaatccattcatggattgatctattcatgagggcagagcctacatgacccaataacctcttaaaggctctacccctcaatactgccacattggggattaaatttcaacatgagttcgagtgggggcaaacattcaaaccatagcagagaatcagacaaattgtgctgcgtccacttggaaggcactgttccgcatagggttggtttgggctccttctgatcatgattggaattagacaaactctctggaaacacactcacttacagactttgctttctgtgagtatttttttttttcctgttaaagctgactcttctatgttcagacccatatttttaagttatctttttacactgaaattcttaatctttcaagtttagatatggatttaccttgattttatggactgtgaatgccctcttttcttatctttttctattttatctatataatgatactaccatttggggttagatcaatatttatgatttacattattatgactatgtaaatattagctacagctgagccacatagtatatgatgaacactttttctattacagctttgtgtttttcctaggattaataatcacttgcttctttgtttacttagttttcactgcatgtgttactaattcattccccaaattctccaacggactaaacactcttcttaatacattcagatgcattagcgtgcttgaatgtttatttttttcctggaaacatctctccaggagccttctttctgctttaatctggactgatttctgctgtatgtttgttgttctgttatcgttcacagttattctggaaattctttttgtttctcacctatgttgtaccgtctgttttctggatatcgtatgttctttctgagtttgcaaccttttaattcattttttaattgctttttgaagaagggtacatgagaggtcaaaattttgactttgcatgatctaaaattgtcctcgtttacttgtttgatactttgagtatggaattctaggtcagtcacaccttgctttataaatggctgcacactgaggtccagaaaaggcaggcccttggtctccacactcctaggtcagaacctgagagcaggttccaactacagagaaccccagaaatgatggcaccttttctcacaaagaaatgctttttccacctccacagaggtctgccttcggttacatttaagtgttgattgcattgtccatacactcagtgctgtgtgagcacacggtttacaaggatgacaatgccccctttgctgcattcaaggtacaaatgttttggcaatgaataaagtcacatatacgaacagtctgttgatatgcaagggcaaaaatacagaactggatcaggtggtatgagtacaagggatggtaaagtcaggtgagtttcattcatgcagtattccccaatgtcctctgggaagatagaagagtacctcatacctggagcccggacgcaggtttttttttccatcactgctttggcgacagtaggcattgctgataagaaaaggcaactggacatctacactttgtcattgcttcctcatcctgccacagaagcttcattaacatggaaataaagggatttacaaacactctaaggacaaaggggaagagagatgagatgctggcagtcatgagatgccaatggcaatggatttaacattgtggagaaagccaaaagaagtcatactagaggaagccagtgagccagtctctcattcagagcaaaccctggaaaggctggtaaattcgagggaccagattagactggagtcaatccttaaagagtctttcaaagtttttttaaaaattgtcatcactcatgacttagggtgtatttgcatttatgagaatggtcatttattttgtttctgaaacttaaacctgtgcgttacatgaagaaagaaattacttaaaacattagatttctgtaagtccttaggtcagagcaaaatgaaaaatgaagcacttctgaacatagtgaagttctagcaaaagaaaataatgctcaacagtgtattagtcaatgaaactaagaagaatttatgtctttttgtcatttcacttcagtgttttcacttaatgctggagtgaaaggtttaattaccgaacttggattttacatttttatgctgaggtaccagtcagtctctggttataattcattttcttctttaatcataggagaaatgattcagttggctttggttaacgtcctcctccccttccctttgataatcttactttattgttgcttcactgtttttttgttgctatttcacattgccatgtttttggacattcaattttgtaattttttccctctctctccaactctttgcctcttaatctgcagaaagcaattctgttaacattattgtgatgttatctttatttctctgttatttctgctgattttcttcatttgtaattctttacataactctgtactctttcttcattcgtttgttctattcttgttccccagtttttatgcttccgaatcctaaggagccatttacatcattttggtttattcatgtgctttactgcctgtgatcataatgctcactgggtcttctgctccttccaaatcgctagccactttcatgccttttgaaacctttgagcttaaaatgtaaatgccggaacgtagtaaaccacatacatattattcattacagattctatattcctctctgaaaatgtacacttaacccctagcaatgttaatgagagtgactttaatccatccaaagggatggagagacttttatctctaaaatgaattccctatacacatatggaagtagtactctagaaatggattgcaaacaatactcagacattttctgggtaaaacactaatttatttttactttttttctccagagctttgtaaaacccatggcaaaaatcaggctttttccttcttgttgcaaaataagtacaaatattggataaaaagaacattcttacacaaagtagctaaaatcttcgaagtgtgttcttatagcacctcagaaattctttttgtcagccactcatccttgtggtcccttgatatctatataatggaatttagattatagtagatgatgtatataaaatacagattgttacttcttaaaaggaatctctttagttatatgtagtatgaaaaccataatatttttcttttaaacatttatttatgcattcaataaaaaatgtgagggcttctattatgtattagccagcacaccagctgcctctaagaataagattgcatcatctcctatgaagcatgctgcccctcttctagattgcaatggagtggggtgcacatgcaaaatagctatgaaaacattgatgacagtgtgatgcaagaagctgaaaggtaggacacggtgtctagtatgaaaggtagaagaccgggaataaattctaaggaattggtgtttagctgacattcaatgaatgagtaggagttaattggataaaggagggtgaagtgttccagctaagagcctagtaccagcacagaccccgagttggaaggggattggggacctaggacactgaggagaccagcgtggccagaccctagtgtatgacagctgtgagatgacattggattttttctactcacagtttcttaacctccaacattcaagaatgcaacctacatctcaacaaaaaacactgttacgttaccctaatggtaattagcactaaaaaaaaaaaaaaagagcgagagagacccagctctcagttctccttttggattttatatttttcactttaattccagcagatttgcttcatgtcctctgaagctcttttattaggtacatagacatttaggattgttatgtcaccttgatgaattgaccactttatcattagggaataaccatctgtccctagtaatatttcttattctaaaatctactttgatattaatataatcactcccactttctttagagtagtgttagcttatattttttctattttttttacttttggtctatcagtttctttataatagaatttctcctggatagcgtatagttaggtatttattttttattcaatctgacaatgttttacttttaagagtgtttaggcaatttatatttaatgtgatggtcaatttggtttcgtttaaacctatcatcttgctaattgctccctattttttctatctgtcctctgttcctttatttttctctttcttgccttcttttggattaatggagtattttttaaattgtcaattttacctgcattaaaggattaacatgtaagttttgtttttattttgctttgtaagtggttgcttttagagtttacaatgtccatcttcaaagtaacatggcttactttcaaataataccacttaatttatagaaggaccttacaacaataaatttttatttcctccttcctcctgcctttgtgttaatattgttattcattttatctatatgttacaaaccacacaatgcattattattgccttaacagtaatgtatcttttgatgatttaaagtgagaaaatatgattttatattcacccacatgcttaacatttttgtcactcttcatttctttatgaagtcacaaatttgcatctgatattatttcttttcttcctgaaagattttaacgatttttgtattgctagtctactgacaatgaattctcagctttggaatgtctagaaagttattttgtctttatgaaaatttttctgcatatagagctttaggttgacagtttttctttcctgtcttttttttaaaaaaatgcttcaaatttctctccccttgtcttctgttttgcgttgtttctgatgagaagtctgctgtcattcttatctttgtttctctaaatataacatgtatttattttttaatctggttgcctttaagtttttttctttatgttggatttgaacaatttaatcatgtgtcatgttgtggttttctacatgcttctgtttggtgtttgttgaatttgatggatagttgaggttctagtgttcattaaagtttgaaacttctgtatattaattgttcgattttttttctgtatctcattttcatcctagaactccaattatacgtatattaggccaaacgatattggcccacatctcaccagttttgtgtttactgtttttaagcctttttaaagtttgtttttcaatttgggtagttttaattgctctgttttctggttcattgacagtttcttctgaagggtgtaatctgccattaatcctatttgtctaactttcatttcatatattacattttgaatctctagaaggtccatttgactgttttatttgcagcttggctgtttgtattttctccatttctctcatcaatgagctcttcctttttcctactgtcttgtacatattgacagaatatttataagagtgatgttaatatccatgcttgcaaattgtatcatctctcatttatgtgtctttctgtggaatagtttactcctaataatatgccatatttcccttattgtgtccaattttttattgaatgacagacattgtaaattttatattattgattgattgttggtttctattaattatcatcaaagttttttgttgtgcagttcaattacttagactcagtttgttcccttctaggatcacttttaaattttgttatgattaatttgtcccctgcagctgtgtgatacatttctgaatactcaatctgatgttctatttattagaagttcttacctcttttgctggttgaaacatgaactattttctcccctgtgtgagcttcacagattttcacccacttctttctggtgttcctaatccaaccttggtagttttcttacacgcatgcaaatatcagcacacagttaaggactcatcaactggaagctccttccgctctctggagctccctctctatataacttccttctttccactttgtaaattctagcagccttagtcccctcaagtgtcatacttggtccccctaaccccacaatataaccaagttttattcaaatttcctccttttggaattatcttagaaactcaggaagtaagctgggccactcataaggtccactttgtttgtttccttctttcattttttttttttctgtactgtctgaaactttagtgaagacatagagtaaatccagttcttgtttctgtgtttttgtttgttgttttatgatggacagagacagaatttcatatttctaagtgatgacagttgcaacatcatttcacagcttgggagtagatagaatgagtgaaatatattaacgttaaaggcaaaattgctataacatatgagcacattttaataacctgacttggaatcacttcatagaagccttggaatgctttccaagtcattataagcccatcatttaactgatttgtgattgtctgatcgagatgacactgaatttctaagcatttatccaaagaaaaaaccattttggagtctcagaatcagctaaatgttatgctttctagatatgtttacctaaggctaagttatattccctttcattttggaagacctttacacaagcagttcattttagtaagcatacccactcacgtattcctatgaaatcaataaagctaacttgaacccaaatggcatttccattcaaaattaatgtacccaatttgcaaattcgatagcctgttttagttctcatgttttctgacctctctgaagcaattgacagtgttgaaaactgttggttaacgtctcaaaatgtctttttgtttctaagacatcactctctagggtttgagctactgatctcctaatttcctatttatctccttcatgatttttttccaatttctttaaactcttttaattttttaattgaaatgttacatacatgcaaatcactgtgtacacatgcagtgtgcccagcacccagatcaagaaaaagaacatagcctgcaccttggatgccacctcatggccctttccattctctgcacctgaccccacccccacgggcaaactttattctgactctcaacatcatagattagtttttcctattttgatgtttgatataaatggaacaatacagtgtaaatccctttggtgtctttttgcttttcttcaccattatagttgtgtgatttataatattttatgtgcagattgttcattgttatcagtatgtagtgattcaaggtgccaatatatcacgatgtatcaattttattattgatcgatatttggtaagttttcagtttgtgactgttacaacgtgttgctgctgtagatattccagcgtgtattttttgatggacatatgcatgtgcttttgttgtataaatacttaggagtgaaattgttgagtcacagtgtacacatgtgttccctttagtagaggctaataattttccacaataactactgatttacattactacctgcattgtttgagggtcttgttgctccacattcttaagaccctcaatatattctgtcttttccattgtagttattttggtggatgtgtagtagtaccccactgtacttttaatttactttttcttaatgaccagtggcattgaagcactttttaatgtgcttattggccatttatatattggcctttgtgaagtgactgttcacaccttgtgtgtgtgtgtgtgtgtttttcttctttggagacaaggtctcactgtgtcgctcaggctggagtgcagtggtgcgatctcggctcactgcaacttccaattctggggctcaagtgatcctcctacccctgcctcctgagtagctgggactacaggagcatgccaccacacccagctaatttttggtagagagagtcttgctatgttccccaggctgatcttgaattcctgggctcaagcgagccacacacctcggcctccaaaagtgctgggattacaggcatcagctactgcacccagcacttttgtccatttttgttggactatctttttatattggtgtgtaggagttcattatgtattttgggtacaaatcttttgtcagatattttcctaccttataaaatactccctatccctgaggatttacttctggtttttgtctcttcttgttctttacacttgatatgccttggctgtgccctcacccaaatctcatcttgaattcccacatgttttgggagggacccagtgggaggtaattgaatcgtgggggcaggtcattcccgtgctgttctcatgatagtaagtctcacgagatctgacggttgttagaagttttcctgcacaagttcactccctttacctgctgccaaccatgtaagacgtgacttgctcctccttgccttccaccaggattttgtggcttccctagccatgtggaactgtaagtccaattaaatacctttctcttgtaaattgcccagtcttgggtatgtctttattagcagtgtgaaaacaaactaatgcaacacttttcttggaatatctcacccagtgatagacttaaatttccctggctgccaaatatgtctctagggtcttggactcctatttccaatttgctattgggtggcccaggggcagtgccctctttacgttagtgaaactgacatgttgtttcctttaccaaccagctctgtcttgtaggctctctttgtaatagtgtaactgtgcaactgggtatgcaagcaattacatttgcctcctattgactttttttattttcttcactctttttgctcccacatccctgcccaccgatgctggtaggatcatatcagacatatccataattaggccttttttctcccttctcaccaccaatgcccagctggcctagactcccagcagagcagtctagccaggctttctgcctgcagtcttctctccctgtctactcagtgtttactttctcaaacttcaatttgggaaattgattgttcattgtcaaaactttcattgacttcctactttttaaaatagctttattcaaatataatttagataccataaaaagaatccacttaaagcatacagtttagtggtttttagtatattcacagataaggtgccttcaccacaatcaattttagcaggttttcatcacttcaaaagaaaccctcctatcctgtcccgttacccagtcctaaccataagtaagccactagtcgactttctgtctctacagatctccctcttctggacatttcatacgaatggagtcatacagtatgtggccttttgtggctgtaattgagggtcatccccattgtagcttgtgccagttcttcactctagtttattgctgagtgatatcccattgtaaggctaagccgcattttgcttacctgttcttcaggggatagacatgtaggctgtttccaccattggccattatacataatgctgctttaaacatttgctcacagttttgtgtggatgtatgttttcatttctcctgggtatgtgcctaattgtccttattgtctgcagggctaagcgcatgctttttagcttggcacctgacactctttacaatcttgactttataatcagcacccttccacgccttggttattagtgtgtctgctggtcttggcacagtgccagatacatggtaggtgctgaagagtgtttccaagataaatgaatctaagaaacctgtagctccctctcctaatcgtgcaacacttttagctgtgcattgaatttcctgcttcccagcacctttttatttctctcctgactgggacaactcaatgtcctaatattttttaagacttctgcctagaatgtacttttctttcctcctctggaaagttgtttccatttttcataggtcagattagtttctctatcacttatgcttctgttgcattttgtgaatgtttctgtcacaaccttcggtaaatagaattataattgacctcactatgtgaactagagtacccttcagactgaaatttccttggcagtagtaccaggacttgttatatcttgcattactgggcccttacacaagacctggtacctagtaggtgctcaataaatattattgcatcagtgaatgcttgtgtcactgcctactgcaaaattcctcccacatctccccttttcaccctgccctgtttgaattttaagaaaagctaaaatattgatttattttctttttggtgtaacactcttctttatgtttgtcagtggagccttggttatgccgtctgttacagggatgtaaaatattgagaagtctgcaactgaagaaacaattctccaaggtccctcccattagctcccttagtgttggtaccccaggattttcaaccctgaatttcacaagattgtgctgaatgtttcatttagctttctgttttgaacccacagttattttttaggaactttcacacacacacacacacacataattcacattaaggttgcctctgcccttactggaggaagcaaatgttactgtattaaagagcaggaggcactctataaaaagaagtgctattatttaggcagatggatggtcccttagatggaagaaacaaaagctgttggaatatagtttgggttttcttttgcctgtggccatatgatgtgtctcttagagaatgagtttatgttacattattaaaccctgtggcatgaaggagaaagactaatgtaaaattctttaaaaatataaggagaagtgacagtaatcccccataggtcgcttatctctttaactgctaggattaaacatttatttatcatttttttcctgcagtcatttaaataatttcacaagctggcttgtggaatgagattttcaataagaaactatacatttaattaagcaatgtttcttgtatacatttacatttttaaagtcttgctattcttaacaagactacttttaggatacaagaggataaattcaaatatgaccaaattttgcttagttcaaattacccacagtcgggttgatagaaaaataatgtagggaaaaaaaataaaagaatcctggtggaattaattagccttgaagagtgacagttacctcattcctaacaatatgtttggggtaatgtcagtttcttggaaagctcaaatgtaaaattacagtgctactatcagcatttttatttgagttgaaaactgccgtgttgaactattaactatgcttctgatctgaaccgatttcttagttagcaataattttcatattctgacttatgaagcattgctaaagactttagttatggttgggagagaaaactataaaacacttacgacttgatgaacacccctgcctctcttctctgtgggtaagagctatcgcttgtacaaaatgtatttttctctgccaccttttggcaattggtgttcactgtgcttcccagcttagccatagccccaactggccctggaggccaaactcttggtttctgccagtgatggagaccaagagaaaaacgatggatgtttcaagtaagatacctggaggatgctaaatctcatggacacagcttcccctagatctgactttccggaataaaggcaggcatataatgaaactaaaatagtgatgtgaaaaggtttcacctattctgtatgagtgtgaagagtgaaactttcgtgaattgttgtcttggttcattttctgctactaaaacagaatacacagactgagtaaattgtaaacaacagaagtttatttggctcatggctctggaggctgagaagtccaaggccatcaggtgaaggtcatcctaggtggaaggatggaagacagaagcaagtgttcaggatagaaagaaaatggaggcagaatgtattattttataaggagctcactcctgtgataatgacaataatccattcatgaaggatctgcctcttacgagtcaccttttaaagtttccacctcccagtaccattaccctggtgattaaatttcaacgtgagttttggcaggaacattcaaatcgtggtattctgccctggcctcctgaaacttctaacatacaaaatgcattcattgaatcccagtaccccaaaagtcttaagtaattccagcatcagtttgaaagtccaaagtctcatctgaatcagatatgagtgagactcaggcatgattcatctagaggcaaattccctccagccatgagctatgaatcaaagcaagctatctaattccaaaattcgatggtgagacaggaacaggatggacattcccattccaaaaaggagaaagaggcaggaagaggtaacaggtttcaagtaaatctaaaacccaacagagaaaacaaccttaagtttaaagctggataagaaacccctttaattccatgtccctcacctggggaacactggggtggggattgggtccccagggcctcaggaaaagctgccttggtggctttgttgggctcttgggctcagtttacccagcagctctcatgggttggagtcttatgtctgcagctctcccaggctgatgttatgtgctggtagctctacagttctgggatctcagggccagccccacttccgtggctccactaggcattactctagtggacagtctctgctgcagctctggcccattaattcgtctcagcaccgccctaatggggactctttgtgccggctccacctctaaaacaagtctctgcccagggccgcaggctttctgggaagtctttgaagtttaggtggagaaagccatgccccacagcttttgcattctgtgcacctgcagaattaacacaacatggatgccaccaaagtttatgattagtaccttccagagcagtaagttaagccaggcctgggaccacttgagccatggctggggcagctgaggaatactttgtcacaatgcagcggataggtcccgagacagcttgggtagcaagccacggagagtgcccaggcctagttattagctcatctagttattagattaatgtctcttctgcctctattctgctccctacttcttcctttattgtgacaatctaaagttggtgcttagtgtttaaatgactggttacatgaccatttagtttcttaacaagatgtagtgctaaaatgcatgagctcattccaccataccaaatcttgaccaccatatgccatcctcataactttctaacagttcttcctaatgaagttttctttctaggctatagtaggccaggaatctcattacacttgcccttcctcatccccacaccaacatatttattgatatatttcctaaccttagttaaagaatgaagttttgccatgtgcactctaaggtatatttgtgcaaggaaagacagcaatccttcccatctctccttagtgaggttaggggttaaccttcttggttttactaaatagaagtctacattccatataggcacacgagagcaagtttcctaatgtaactgtgacacaacacacgtctcaatgccctgcaggattgtgtgtcattgaccactgtgtttatactgataaacttttctataattgaagcctttggccctggtaacatttccatcctatatgacaccagtgaaaagttagagttttcattggtgccatatatggcctaacagccagagtgaccctcagatctcaccccagtagtggacctgtcaggtagatatcatctgccaacatccccaaggaggtgtaggtcttcaagtgtgagatcatccatgttatttccagcattgttgaacaagacacttcttgagacgcacagattgacaatagcttttgatgcttcccctgatcaaggagaaagagggtcttatcgggggcccatctactttggagacatctacattgtgtgtccctcacaggggagcagaattcacatcagtatgtaggctttcctgttcatagtggaaggggggccacagtttgtaagcatctctctatatcaggacctcgctaaaggctttcgcctgtaccccccaccttctctctctctctctctctctctctgtctcaacttctatacagtcagttcctaaactgtgagaggtaattccaatctacttaaaagagttgtaattttgtaaaatagaaattccaaaaatacttcaaaaggttacattatattatcaacagaagtttgacataccacatgaattatgagatgggaaaatgaaaaaatatggggacagtgaatgcaccaactagcatttacgaaacacacacagcttgctaggcattaggcttagggctatgagcccattgaatatgtgaagtttaactaaaaatcaaaatgtttatataatagataaatgttagattctttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgtgcccggctaattttttgtatttttagtagagacggggtttcaccttgaaatgttagattcttacatgagtatgttttcataaaacaaactacacactgtcactgtccagattcaatgggttcccaaaaacataacagcctgagagtcttagttgtgtcattgccttattcaatgtaataattattgcttgtaaaaatgttttaatccagtgataatccagatttagtactttcttccatcttggtgtattttatttattgctcatgctctattggggagcttacatgggatgttagttggcactttctgattactttatttaaaatagaaaaacatttcagaaagacatggttgtagagggtaactagcagagcctcatttgatgtctcctgttgagttacctgaagggagatgctcagaggaagagttgcatgcagaaggcctcctgggagtgtattctcaagagagacatcagcaagggtgtgaggaaggcagaatgagtggagggagaagcttctctgcaaagctctgatgatagcggtctcaggtgggatgcaccttcagcattgttgcaacttaacacgagggggccaggcttgtggagccacctttgaccagtcattccctgcaggcctcagacaaggcagttccctgtaacttgggctggttcccagtgtaggactcaacataggatctttccagctgctttggggcagggtgcattggcgctaaagaggaaatctgaagggagccccacagtgtccaccaagtggcagcagggaagaacatgctgtgagtagagtcaaccacatctattcagccttgtgccaatgcttggatgctgtgcttcctaacagcagggtggagaccacccgctaccctcacatttagtgagcaggttaaatcttattattataagatgagtccaatcacctttgtaaatagtgttaatttcttcatctctttcttaccaaatcatgtcagttaactacaggcaaagtgaggggctcatgtattttatcacatagacttagtagcaaccccagcacatagcaggagcctgtaacccctcagctccacaccacggagaaagactagatctggaagcacaggccatagacccactctatacagagctgcctgtaatccccacacaaatgaggggggactgttatgccacatttggttctaagatgagaaaacaaaaatctcaaaagccttcatcagaaagactgaatctagttctgccacctcctagccctgcgttcttgctcaagtgacagcctgtatcctgtgtccttggtcaagtgacagccctgtgaatctccatgtcaccgtctgcaaagtggagcctttgtttacctagcggagctgttgttcatctcgagtgttagaaggttgtctggtatgagatactatgaagcatacaataaatgttattctcacttctgaccagtgaagttcattcgaaatatctggggcttctcttctctcttacaaatatgtaactaggtatgcacctgctttagaaagtcatggagaagctcagatgtgtgacaagtaggccttcattatatttataaatcttttatttaacttgtaaattctggaagtcacgttttatttcttcacataaccaacactccagaaacacttgttataggcccttaaatgaattaaaaagccaaatgtgtatgaacacatttgatgatatttacttgtagaagcgaaaagagaaacaatttaaatgaaaagagcagaaaaacagttcataagaatatgtataaattgtgcattcactgatatttacttgtgaagtccgtatagaaccatggaataatgtagatgatgtataaaagaattaaacagttataaaaatggtacattttacgtatgtacactttaacatgatataattatatagataaggcatggaggcaggtggaccacaagggaaatgtaaaaatcaaaacagacactgtaggctggtggagttgagtcatgcttttgtcaaaattctctttattgttatgtcctattttaaataaaagtgtattgttgatttgacattgtattttctgataatggtgcttttttaacatgctttactctacaaagaacttaaatttacaagaaaaaaaaccccatcaaaaagtgggcaaatgatataaacagactcttctcaaaagaagacatttatgcagccaacaaacgtgaaaaaaagctcatcatcactggtattagagaaatgcaaatcaaagccacaatgagataccatctcatgccagttagaatggtgaccattaaaaagtcaggaaacaacagatgctggagaggatgtggagaaataggaacgctttaacactgttggtgggagtgtaaattagttcaaccattgtggaagacagtgtggagattcctcaaggatctagaaccagaaataccagttgacccagcaatcccattactgggtatacacccaaaagattataaattattgtactataaagacacatgcacacatatgtttattgtggcactattcacaatagcaaagacttggaaccaacccaaatgcccatcaatgatagactggataaagaaaatgtggcacatacacaccatggaatactatgcagccataaaaaacgatgagttcatatcctttgcagggatgtagatgaagctggaaaccatcattctcaacaaactaacacaggaacagaaaagcaaacaccgcgtgttctcactcataagtgggagttgaacaatgagaacacgtggacacagggaggggaacatcacacaccggggcctgttggggttggggaactaggggagggatagcattaggagaaatacctaatgtagatgacgggttgatgggtgcagcaaaccaccacggcacgtgtatacctatgtgacaaacctgcacattctgcacatgtatcccagaacttaaagtataataaaaaataaaatgttttacatatgatttgcaattttaattaaaaatgtggcaaatttcattgcataataaccctcagtgaagctagtaaagagagcaatttgatcccagcaacaagatctaggcattcacacattcagcttccctttactgagagtccagtgagagctgggctctatgctccaggtaatagtgggagtaaattaagaccttgtcctcatgaggcttatctctagtggcagaagatagacaataagtgaatataaaatatatacagtccaatggtggtcagtgtggggagagaacagggtttggggcatgaggcaaaaaaacaatctattaaaaattaacatccaggataacttaacagtttgtgtacaaaatgtgaaattaggatggtgccttattttttagtatcagcctgtctgctcacagcattttcagaaaatttgaattatttggttttatttgagcctgcgcctcatgattaattttcaggataactttctgaggccagacattgaactgcaaatgtcaaaggcatgttttactcacctatggatccctgtgttgtcttcttgcagttttcagtgaagacctacactccagcctctactttgtcaatgcatctctgcaagaggtagtgtttgccagcaccacggggactctggtgccctgccccgcagcaggcatccctcctgtgactctcagatggtacctagccacgggcgaggagatctacgatgtccccgggatccgccacgtccaccccaacggcactctccaaattttccccttccctccttcaagcttcagtaccttaatccatgataatacttattattgcacagctgaaaatccttcagggaaaattagaagtcaggatgtccacatcaaggctggtgagtacagctctgggctttgttttttctgtgcctgcttgggatgggaggataatgacaatgacacatagcaaaatgccatcacagcagagaaccaatgaaaaccccatcatcagttcattctgaccttgctgatgacttctttaaggtctccttgtttagatttcaaagtgccttacattgttggaactaaaccttgaaagaaagcagtgattagcaagttggcaagttctaacatcccagcctccttatattttgtctaatttgatactctaattcaaattttcagtgtctcaaacccaatgtgtttgcttccacccctccttttttcccacttgcccttcccctaccccatcctaggggaggagaaagagagagaaaaaaatgacaaatggttgagctggaataaaaccatagcatcaagatgtactgttatggaaacagaatcaatctaatatccttgctttccttgtgaaatagaaaggctattttaacatttttgactgtatcacatgttgctgaaatgttgtcagtacataaatcctgaatgggctatgttccttttaacaacatattgtgtctttttttaatcaccattgctacaagtcaacccaggaaagaatactgcctgagatacacagacatcaagggctatatatacaggacagattgtgtggttctatagatttaacaaagccctgcaaaacaaactcacagctagactcctgttagcaaacagcattttaatttttttaagtctagctctgaaatacttgtgtagactgacataatataatagcagggcaaagagaatgtgactttgatttttttcttatacaccaggtagctgggggagctttgcaataatttcttcagtaagtgagtaggtgctggtagaagacatcacaacatgagaaaaatatgaggtgtttctgaattcctgcatatgatctctttgatgtaagccatcaaacattagactatgactcatgctgctagctagtcattttcccaactatattttgatctttgtgacatgctcatgaattccaagacctgcatgagaattcacataagaaagaaaaaaaggattgtctttaatcaagatatatgaaaatttgatgtgtcaaataattacaatgcaatttgtatagggacctctaaacctgacaaacagggagatacagtgaatgacttttactgggaagactgcacattttaatgatgtgttataaaagcgtatttataatctgcaaaacaccacttatagggaaacctagaatttcaaacagctccatctgtgcgtattaatccattatgtctgccttggattttctgtcagataaaggaatgaaatgcttactcctgttttaactatcatcttctaaattagtcatagaattcattgtttttgcatgacactgaaagttttagagcatggacattgcatcatcttgtctggcgtctgtgctacctgcctcttcctacccagttgtgcttttactatttatgtgctggcgttcttgacatctgaaaccctatggactatgaatccagcatatggatgactactgtatcagtttgaacatataagatgggcagtcatattacccaaatcaaatttctctcctgatttcattttgctttttattgtgaacacataatggttataataatcttttaggttgttcactggatacttgaaaatcttttttcatcctgtttatgtaaatatgagtacagaactggaagcttgttcaaaaagacagatgaagggcataaatgctaccctttgacagctgaagggtaggtttgagggtgatgactgctcactcacggggtatcctcttctgtatcaggtcatcctaaatgtctaaatatccctgtagattggtgtttggattttcctggaataagctattaggtagaatgacttcataatctttcccttggcagcacaagggattctcattcttaaatttcagaaattttgacctaggtctgggtgctagcaattgaaggaaggtttactcatcatgtctcattaatcatcaatcctagtcctaacataagatattttcttgcctgttctaagggctggaatgcaggtgggccacttcagacagtattgctccttacccaggctgcctttgctacagagcaagtagcaatgagccgcctgatcctgggcaagtcagaagatttctcatgattgttttctccttagcagactgtgctttctttctttctttctttcttttttttttttttttgagactggagtctcgctctgtttcccaggctggagtgcagtcgcgcgatctcggctcactgcaagctccacctcccgggttcacgccgttttcctgcccagcctccagagtagctgggactacaggcacccgccaccacacccagctaacttttttgtattttcagtagagatggggtttcaccgtgttagccaggatggtctccatctcctgacctcgtgatctgcccacctcggcctcccaaagtgctgggattacaggcatgagcgaccccggccacaaactgctttctaacatttgactaggacttttgcttgtggccgagatggaggtgtgggagccacatttacccttttatctgaaacaaccaaaaaccagtgtcctgaggctgatagggtttaactctatgtccgcacccaaatctcatcttgaatgataatccccataatccccatgggtcctgggagggacccagtggaaggtcattgaatcatggggtaagtttcccccattctgttctcgtgagagtgagtgagtctcacgagatctgatggttttataagcatctggcacttccgttgcttgcattcattctctctcctgccaccctgtgaagaggtgccttatgccatgattgtacgtttcctgaggcctccccaggcagttgaaactgtgagttaattaaacctcttttctttataaattgcccagtcttgggtatttcttcatagcagtgtgagaatggactaatacaaccaactgaaaaaaaacaacgaaaaatgcagacaaaatatctgaagcaaccattttcaagactggacctcaggcagtagaggaaagcattccttaaggagctggaaataagatgtgtcctatgcttgccttatgctttgggataaagaatatcaaaatctgcacataaatttgtatagcaactttattcctaattgccaaaacatggaagcaacaaagatgttgtttagtatgtgagtggatggggataaagaatctctccttgactaactttggaaaggctcctctgagccctcctctcaactagttctcaaccttagcttttcacatctggtctcttgtccccagctttagcaagaatcctgctaaatcatccccttactcttgatacttgatcactcttaatatctgatcaagttcttccagtcccatctttgatgtatacatgtttggcctgattttagcaagaatctgttaggccagtttagcaagaatcctcatcccttgatgtctcctctttctaattttccacccactgctcccctcactgtgttcattggctataaaccctcacttatccttgttgaatatgaagttgaattacccttccctgttgcagtcatcatagatgactcctactggaacagacatgaatataatcttatctttttaataagtgttagaacatttttttctgttctttaatatttttgagaggacatctccctctcttgtccaggtcggagtgcagtgatgggatcgtggctcactgcagcctcaacttctgggctcaggtgattcccctcagcctcccaagtagctgcggctacaggcataagtcaccacacctggctaattctttaaaaaaaaaaattttgtagagggtattctcactatgttacccaggccggtctcaaatttctgggctcaagccatctgcctgcctcagcttcccaaagtgttgggattacaggaatgagccacagggcccagctacaatttttctttaacattagacaaattatagtataaaatgaagtattagtcagcgatagaaaaaatgtgctatcaagctatgaaaagatatgggggaaatttaaatgcctgttactaagtgaaagaagccagtctggaaaagcaacatagtatacccttccacctacttgacattctggaagagataaactagagagacagtagaaagatcagtagtttccaggggatagtcaggagggagggagggttgaacagacggagcacaggggatttttttagggcagtgaaactgttctgtatgatactgtaatggtgatacctgccattatgcatagaacttacaacatagagtgaaacttagtgtgaactatggactttagttaataataataatgtataaatatgagtttattgtcacaaatgtatcacattaatgcaagatgataataatgaaagaaattaaaggatgtggcaagagggagaatatgggaacctgctgtgaacttttctctaaacctacaactgctctaaaaaaaaatcaagctttattcaaaaaaattaaaacatgcttcaggaagcttaatgacaaattaagccccaagggaagggatggtgaaatttaaaaagaagtggaaaaatgcaggccaaaattttccaaatttgttgaaaactataaacccacagatccaaggagctcaacaaaccccaagctcaagacacgtgaagaaaaaatgcacaaaggcacatcataatataataaaattgctcagcgcaataataaaatatcaaaagcagctacagaagaaaggcatattacacacaaaggaacaaagataagaatgacagtagacaggatttttgttgttgctgttgggtgtgtgtgtgtgtggatgtgtgtatatgtgtgttttatgagacagggccttgctctgtcaaccaggctggggtgcagtggggtgatcatcgctcactgcagcctcagcttccctggctcaagtgatcctcccatctcagcctcccaagtagctgggaccagaggtgcatgccgccacatcaggctgatttttatttttatttttgtagagatggaatctcgctatgttgcccaggatggtcgctaactcctgggctcaagaagttgccctgccttggcctcccaaagtgctaggattacaggcaagagtggaagtaaatttataaaataatggtgagatgaaggctttctcagacacaaaatagcagaaaatttatcatcagctgaatcctactacaagaaatcttaaaggaagttctagaatcagaagaaaaaaatgacacctgatcaaatcttagatctactcaaaggaaagaactgcaatgaaaatggtaactacatgagtatctaaatcagattttttaaaaaattgcaatattttaaaaaataattggctatttagacaaaaatagtaacaatgtcttaggtagtttgtaacataggcagaagtaaaacttatagcaacaatagcattaaggcctacagtgaagacatgggagtgtaatattggaggttattttgctatatgtgaagttgtgtaatgtcacctgaatatagatggtgataagttacaaatgtatactacaaaacctaaagcaacctctaaaataacaaaacagagttatagctaataagcccacaaaggagaaaaaatagaatcattaaaaaatcctcaatccaaaacaaagaagaaaatgataagaaaaaggaaacacggtaaaaaaaaaatacatatcaaatagcaaaatgataaacctaaccgtatcaatatccacattaaatttaaatgttccagtaacctgaattataaggcagaaattgccagattggatttaacactgcttaaaagaaacattctttaaatacaaaggcacaaatagcttaaaagtaaaaggataaaaatgatataccatcctcatcaaatcaaatcaacctaattaaagtaaaccactgaaagaaagctagaatagccacattaatattaagcaaagtgtatttccaaacaaatacactgtttgctcagagcatcttgcattagtgtgatacatttgtgacaataagctcgtatttatacattattattaactgaagtccatagttcacattaaatttcactctatgttgtaagttgtatgcataatggcaggtatcaccattacagtatcataaagaacagtttcactgccctaaaaatcccctgtgctcagagctaaagcagttcatttcataatgtaaaggggggaggtgaagaggatatgactattgtaaatgtttatgtacccaacaacaaaacttcaaaatacataaagtaaaaatggatagaactgcaatgagaatcagacatatcaaaaattatagccggagatttcaatactcctagttcaataattggtagaagtagacagaaaatcagtaagaacaaaaaaacacgtgaatgacactatcaatcaatttgatgtaattgacctttaaataaagaacattctatccaacaacagcacaatataaattctcttctgagacacacagacatttactaatatagaccatactcagagcaacaaaacaaatctcagataaatttgttttaaattcaagttgtataaaatatgttgtttgatcataatgaaattaaatcactaacaataacatctctgagaaataaccaagtacctgaatactgaatagcactcttttaaatgatctgtgtcaaaaaaaaaaattcagaaaaaaatttgaagaaggaaattagaaagttttttcaactgaataagaaatgaacacacaatatatatgaatttggggagtgccactaaaaaaatagggagattttattgctctaaaaaacttatattagaaatttttaaaaaagtcttaaatagtggtctcagcatccattttaaactgaaaaagaggataaaactaaaactataagcagaaagcaaacaatgaagatcagaatggagatcaataaattatagaacagaaagaaacaatagaggaaatctatgaaactaaaagttcttttaaaaaaattgttaaaattggtgtgtttttcaccagaaaagtgagagagttggtaaatgactaataccaagaatgagggagataacgtcactttatcttctacaggtattaaaatgatactaagagaacattaagaaaagtagatgaaataaaatattttttgagaaacacaaactatcaagactcactcaaggaaaaacagataaactgaatagccctatatctattaaagaatttaaatttattggtaaaaattctctacagtaaaattcctggctcaaatggcttcactattgaattctactaatcctttaagaaagaaataataattttggccaggcacagtggctcatgcctgtaatcccagcacttttgggagaccaaggcaggagaatcacttgaagtcaggagttcaagaccagcccggccaacatggtgaaaatccatctctactagaaacacaaaaatcagtcaagtgtggtgacacatgcctttagtcccagctacttgggagactgagacaggagaattgcttgaacccaggaggcgaaggttacagtaagccaagattgtgccactgcattccagcctgtgtgacagagtgagggagactccatctcaaaaaaaaaaaaaaagaaagaaagaaagaataaaaattataaacaaattcttccagaaaattgaggagagagtatttcccaaatcattttatgaagttagcattaccctaatacataaacaagacataagaaaactaaagacaagtatctcttctgactatacatgtaaaaattctaaaaatttaacaaattgaatccaacaacatataaaaggaataatacattatgaccacaaaggcttatattcataatgcaaggtgagtttcacatttgaaaattaatcagtgtaaaccatgtgatcatttcaacagacacagaaaaacattgatgaaacccaacatccactaatgattaaaagaactctcagaaaaccatcagtagaaaggaacttcctcaatctgataaaaagcaactacgaaaatcctgctatagcgaacatcatacttgtcaaagatgaaatgttttcacccccaaatgaagaacaatatcaaagtgtatgctctcaccacttctattctacatcgtcctggaggttctatcctgtgcaacatgacatgctataagaagatgtgctgtgacccagaccttcttgttttatttctagagcataggcaaagtagatttgtcataattaattctaagaaataattttagaattattgaaatggtaaatgagcattgacttcatcttagtcatcagctgcattaacccttaacaagaatcagcttgttttttgaagcattgaggctaggcattgacttctcctctctagctatgaaaatcctggatggcattttcttttaatagaaggatatcttctgtacattgaaaatatattgtttagggcagccaccttcatcattgacattagctggagcttctagataacctgctgcagtttctccatcaacacttgctgcttcaccatgcatttgtatgttataaagattgcttctttctttaaatctcagtagccaacctctgctagcttccagtgtttcttctgcagctttcccacccctctaagcctccctggaattgaagagagctaaggacttagtttgatttaggctttcgcttaaggcaatgttgtggctagtttaatcatctctccagatcttctatctactcaaattttctccacaccaccagtaaggtagtttcactttcttatcatttgttcgctgaagtagcacttttcatttccttcaagaacttttcctatgcatttacaactcggctaaatgcacaaaaggcctagctttcagcctgtcttagcttttgatatgccttcatcactaagtttaatcatttctagattttgatttaaagtaagagatatgagaccatttctttcacatgaatacttaaagaccactgtagggttatttattgatttaatttcagtattgttgtgtctcaaaaaaagggatgcttcaggagagggagaaagacggaaaatggcatgtcagtgaggtgggcagagcacatatgacctgtattgattaagtttgctatcttctgtaaatgtggtttgtggctccgcaaaacaattacaatagtaatatcaaagatcactgatcaatgatcaccgtaacagatataatgattttaaaagtttgaaatattgtaagcattaccaaaatgtgacacagagacacaaagtgagttcatgctgctggaaaaatggtgctgatagagttgcatgatgcagggtttccacaaatcttcaacttgtaaaaaacataatctctccgaagtacaataaaatgagtatttcatgtgagaaacgcacatacagccatccagatgcaaagaatggactcagagacacgaagaacagcagaagcgactctttttttttttttttttttttttttaagacggattctcgctctgtcgcccaggctggagtgcattggcgcaatctcagctcactgcaacctctgcctcccgggttcaagtgattctcctgcctcagccgcactagtagctgggattacaggcatgcgccaccacgcctggctaatttttgtatttttagtaaaaatggggtttcaccatgttggccaggctggtcttgaactcctgacctcaggtgatctgcccacctcggcctcacaaagtgctgggattacagatgtgagccactgcacccagcctaagcaagacttttgatgcaagatcaggcgcctgttaggcaggcacacccagggcaggtagagcaggtaatttattgcctagcaagcaagtccctcccccagttcctcattgattgagtactatggagttacaatcttcctggacatcgcctaagtttcattatcccccttttaaagttataacccaatccccttccccacttaagttttgatttcccagtaacaaaactttcttcccttttatgggctgacccctcgtctacattctgtttgcttatcgtgaccttctaggtgcatgagccatgcaatttgttacatctgcaggctggctgccagtgcttagatttattatgccttgaaaatggaccatttaaaatgttttctcacattcgctgctgtcaatgtagaccaaccgtgtgatctcttgctcaataaataagccatgtgtgtgtaatcaaagtaaagttgatttcagttttaaataacttcttataactataagatgcttttcgtaagcttcatggtaaccacaaagtaaaaacctatagtagatatgctaaaaatataaagaagtatgaaagaaattgaagaggacacacacacacaaaatggaaagttatttcatgctcgttgattggaagaattaatagtgttaaaatatctatactactcaaagtgatctacagattcaaggccatccctaccaatgacattcttcacagaaatagaaaaaaaaatccttaactttgtatgaaaccacaaaagactccgaaatgctaaagcaatcctgagcaaaaagaacaaagctgtaggtatcacacagtctaatttcaaagaatacaacacaggtgtagtactggcatactatagcatagtactgacataaaacagacacatagaccaatgggatagaatagagaatccaaatataagtccatgcgcttatacccaaatcatttttgacaaaggtaccatgaacacacattcaggaaagggcaagctctttaaaaattagtgttggcaaaactgggtatctatatgcaaaagaatgaaactagatccctgtctttaactgtgtatgaaaatcaactcaaagtgggcaaaatacttaaactaagtcttgaaactatgaaattactgaaagaaaacactagggaaacactatagaaaattagtctgggcaaagatttttggggtaaggcctcaaaagcacaggcaacaaaagcaaaaatagacaaataggattacatcaagcagaaaaactctgcacagcaaagaaaataaaaatcagcaaagttgaagagacaacatgcagaatggggagactattaatatttgcaaactctccatccaacaagaatataatgatggatgaaactggaggttgctatgctaagtgaattaagccaggctcagacagacacacattacatgttttcactcacatatgggatctggaaaagtggatcttatggaggtggagagtggaatggtggataccagaggctgggaagcaaggggatgaggagaggggttaaagagtagttggctgaggggtataaaaatacagttaaatagaaggaatatgttctaacatttgctggcacagtagggaaattatagttaataatttattgtatatttttaaattgctagaagaaaaaagatttactgtgctcccaacacagggaaaagattgaagtgattgatattccaattaccctgattttatgattatacattttatacaggtatgaaaacatcacatgtaccccagaatatgtacaactcttatatcacaatgaaaatatttgattaaaaaaataaataggcctgattttgtttcaaagtcatattaccagagatttttttttcttctgatctaaaaagatgacagattttactgaatgaaggctaaaatgattgcagtggaccctactggcatccctgaatcagatcccccaagatctgcgcgctggttgctaagaacatgaacctgcagccttcagaggattgcttgggcactggaaccattcacagaaacaagagtgggaaatgcctgggagttccatcctcctgaggccagccctaagccaatgacagacagctacaacaggggatcccagctcctctgcatgaccgagcatgtcaggtgtggctgggacttcacctgaaaccacacacctgctttgctgcttccctccctgccctactcacactttccctgcctctcaggggattgtgtccttgctcagtcgcttgaacccagctcctccttttggggtcgaataaggagaagggatggggagtgtgcagttttcttctgatccccgttctctctgagcgagctggggttcagagcaccacagtgctgtccctgctttgagaagatctgggctctctggggagagcctaacttatgacaccaagcacagtacttagataatactctgtcttataatgcaaatgtcaatcaaatttaaaacaaagtgtatttttttttttgcctgcatctcaggtttctagcccagtgtctgttactgcaacaaagttagcagtagttggatgtagaatgaagatcaaggctgcacccctgtcttcggggctgactatgggctcaggaaactcacatggccctctgagagatatatcgccatagacagcaatgttggtgtcttaagttatggaggcctcaggaacaaacaatgctctattacaaagattaggagctttaataaaaccctgatttgcatttttttaaaaaactatagatagtggctataaattcaaatgtgcatacatgtatattctgtaaaaggattagaagttctcccagaatggaagctctgtctttctatatattcagtctcaaaatatgtattgaacacctcttgtgtgccaagtattttctaagataattttttaaaggctcactgcacaggctatctttgtggaatgagtaatcgaataaggagaagggatggggagtgtgcagttttcttctgatccccattccctttgagcgagctggggttcagatcaccacagtgctgtccctgctttgagaagatctgggcttcttgggactgacctggaggttggagaagcaaaagtcacacaggtttaaaattgtgactactaaggtgtcctggtactggtgagggcagtgggtagctagagaggagaaaactccatgatatgtgggtaagtgctgggactgaggggtttcctaggacactggacattgggtggtaacactgggaatgtccccggtcagtcaccccatatttttatggctcctgtgatcccatctagtgtaggctgtacacctggtgggaaggcatttcccgtgtctcccggtaaacaggtgaacatcttttcttctcactttcctgtctgatacatggaacttgacccctttccttgatttctattaaaaattatcctacttgagtcattaatgtttgaagcaaagtctgcggaaggtttggggagacagagtgattttattgcaaagaaacaagcatcacacagacaaaggagcttaaattgaaatcattcccctgcttaggggcactattcctgtgacggtagactctctctgttgaccagtccctctttctcctctgtcctccatcctcctcttctcctctctgtcttctgcttctcaccatgcccagattctcaccaatgagtttgattagtttgcctatatcttcatagtctttttctaatctattaccgtagacctcagctcccagcaaaggtttacttatgcaggagcctttctgtacaaagtcagttccctcctctcggtgtaaggatgttgttgctgaggtcagtctcttgggcgccctgaatttttgcctagtggacctcctgcaggaggtgtggagttgctgcctggaccttcacctcatgccgcttggggattacagtgatgggggtcgcagaagatttcaatacttggaaaaatctctctggttagatacaataatgaagaaattctccaagttggggaaaaacggctaatgttaaaaatggaaactggagaggaaggctttcatgaaagacatgctttactacaaaaatgctcagcatatcacaaggttagcccgaccttaacagtcctcttctaaagagctcacctctgcctactgggagatttcccttgagaaattcacctttagctttgttggtgtgttagtaccttttgaaaccattttcatggcacatatttgtccagtaagtgattaattctttaagtgaggtggttagatgattagacaataagttatctctgtgggtatcttagaaaatcatagacttataagatttagaccttgaagaggttcccaccacaatgccctcattttaaatttgaggaaaacaaagctctaaagaagtaaggctggcacatctaattgggactatattcatcagtgtcttacttccctggagacagatcttccccaaccctggggatccatctctggctattggtaagtgtggccttacccaacctgcttctagcagacactgttgaattttcacctacgttaactgattcaccacagtcaccctagggggcagatgctaccaacatcatccccatggtatagatggtgagaggatttgctcactgccccacagtcagggagtggccgagcttggatttgaacccagggagttgggcctgctaggtaggttttgaacaccagtaccaccctgcctctgagcctagacatcaaggacgtggaagtccactctgcagtctttctgggatgctcctatcattggagtgtttgggcaggctgtctaatcaacatccttccctaaacaatgggaagcaggatcagtgtttcccaaactgctttgcaactgtcatttaaaaatttactaatgaaaaattattttaattgtctcagagttctcaaggcttcccagaaaaattgccttgcctgaattttttattcattttttgcagtcagaaaaaaaaatcttcctcggcccttagaggactaatagcagtttgccatcatcataactttgcagagccagtaacttttctttcatgaagctatttcctatctcatgataccttcagggggtctattaactattttcgattatactctggccccttggtataaagtgtagtgtatttttttttcttcacccaggctgggtgcagtgatatgattatagctcactgcagcctcaacctcccaggctcaggtaatctcatctcagcctcccaagtagctgggactacaatcacacaccaccatgcccagcaatttttttgtatttttagtagagatggggtgttgccatgttgcccagtctggtcttgaactcctgggcacaagggatctacccatcttggcctcccaaagtggtgggattacaggcatgagccaccttacccagctatgtattgttaagggaatgaatgttttcttaagtcaggcgatgaaagacgtgaaatgtaggcatcttaactgttttccagaaagatatgttatgcaattgatgtgtgtgtgctgcagtgtatatattacagtgagatactctcagaatgagcctgttgaccgtgtgccttactgacgtcctctttctgccttccagttttacgggagccctatacagtccgtgtggaggaccagaaaaccatgagaggcaatgttgcggtcttcaagtgcattatcccctcctcggtggaggcgtacatcactgtcgtctcatgggagaaagacactgtttcacttgtctcaggtaggctttgcgtctccagggtgcaggacaccacgctcaccttctgaaaaggttatttcagagatggaatcgggtctccgtttatgtgttcatcataattcagaattagtattcttaaggctgatgctattttgtaagtaaacctgaaataagtgttttgtattggcttataatggcttgattcagacatcctttggtgggttgactgatgaagagagattagttaccggcactgtaactgtagccattgtgttaacttttttgagaaaattgtggttttacgtctgcttctaaaaacaaggtagtagtattttgcatctgtgagagacctcagcattgcatatatagctgacattctgaaactaaaatctggaaaatggaagccctgttttcatgaccttttggtgctttccaatgtcttgagagttatgttgtatctctgacctatttcttgaagattctactaagaatatatatgtagcaatgaaatgtatatttgcatatgaataatttcttggcttatatttggtgtgtagaaaagacaaaatttaaatttagcctccaagaaactgcagttcttcatttctaatggtgttgatttcttgctctgtgctatttacctggaaaggcgactgtccgcgtgatgcatggtgctcctgttcttacatccttggataatgactgttggcatatctcaaaatgtgttggctgctttcggaaaagaattgtgaggagcatagtctgtgttccgatgtggattataaatagttgccttttttagacatgtctgtatgccctcacatgcgggtgcacacacgcacaacacacatgttaacagacttcttgactaagcaacattttatccatttatagagagcagaatttggaactaaaccctcacggtgacacaccgtttttgtttctcagcttattgattagctagagaggttggttactgtacaccaccaccagaggcatttaaaagatccaaatcaaagttgaaatacattgccatcatagcacattacaggaatctaggatagaatggaattcttagtttttatgaaaacattgtctttacagtgaattcaaaacccctcacacttcaatgaacagtacattccttgctgttatgttgattaattatcataatttaacttagggtgttgaaaaatactaagcttaataactcaaatgcgattgtaataatcagaatagagactcccttatacatttttatttgctaattttcagtgttgaaacatcttcatcttctctccttaggggtcatgttagttgtcttaatggcaaatggaaggatttgatgacagtcatctggctaagctcggaatcaaaggggagaggccctccaatttatatggcaagggagtataggttcagggagtggaagaattgggagctaccttttcaatcttccggactcggtgacctaggatagagacttcaccatcttttaaccctgtcatccaaattttcagcttcatggtctgctctggcagaggaagagagcatgggagaattacaaacgccttcttagtgcttccacttggaggtgacacatgttatctctgttcatatttaattggccaaagcaagtctcatggccatgcctgacctcaatggggcatgtgcctgaaggaagaggagaactggaaatctgggtgagaaattgaaatatctaccaggaggatttttttaacttttattttaagttcaggggtacatgtgcaggttttttacacaggtaaacttgtgtcatgggggtttgttgtacagattatttcatcacccaggtgttaagcctaatacccattaattatttttcctgatcctcttccttctcccaccctccaccccgaagtaggccccagtgtgtgttgttcttctctatgtgtccctgtgttctcatcattcagctcccacttacaagtgagaacatgttctaccaggaggatttttgaatctctttggttatgcataatacgtgtgttcttttgtttttagacatctttaattagcagcatcctcattgttcttgtttcacctttttgcaatctctgtgaacagactttattttccttcaaatgtgaacctaactaaataaaaaaaaggaaatgtgtatctagtgaggggatgatgctggcatgcaatatagaatttatgcccctctgataggaactgttaaagcccatgtcctctcctcagtcagatactggagcttcatcctttcatacaattttaaatgcaaaagttttggagaagtgcttggtttgtacttcacaacagcatctagaaaataaatacaacacaggtgtttatcttattaaggaatacatcagtaagaagctttggttggtttgtaagtaaatcactgaaagaaagggagagagagacttcatatcaggtcgttcaacctgagtcgaatagacttgtcactaaaaatgaccttgtaaatgacaacaaggccccaaagcagtggcatgatctgctaatagaaagtctggaaattgagcattttacctgacttctgttgctcactgctacagtcagaccctgttcccagtgtctgagctccacccatcagcaatgcccagaaaaggaggtcatgaagtcactggaggtgacgcatggtttaaaacattggagatcttaataaataaaccatgctcaggaggtttaggtggagaagggttatatttctctctggttaccagcacaaggcacagataaggacagaggacagcctccctcccccatcacccaggctgtgccggggtggaggccgctaaaaggaagaccctccctccctccacactggctggggctgagccactccagggaagcactgggattcttggcttcagggaacgaccttgcatagcacagaagtcccaggaacagagggactttttctaaattagccctgaccttcagggaagctgtcctgaatgccatatgcacagcagatgacctgtaaaaggttaatttgtctctgctttgtatataaactgtaactcctgcgagctagtttggatttattccttggcatggccatctcccaggtccctcttcccggattatcaagtcatcccagcctgctgggatctggctgggaagtttgttccaggaagcattcgtactctgcagagatcacttccttcagtggttgattctttccatggagaaaagcgattaactaaatcagccatggaaataagcctgtgtaagtatcttactaagtgagtgagttaggagcaggtatgggagtgccagagagttgacctaggatagctgagagctgatggcagtcaagagagggcccaaaagcatgattcacaggccatggcccaacgtgccccactgggctcagggcgaagtgtgacctgtcagcctgggggatgcttagctgctcagccttgactgttgggagatcccctgggaaggtcggagcagcaaagacctgcttctaacagatgagctttgggtttctgtgaatctctaggccaggggacctttggaaatcctggtgaaggtaaatgggtatttgtcttctacaaattcttttttaatgaaaagcaaaattaaagatgtttgtgtatttccctaaaaagaagcaaaatggtttctattagtatgtctcactaggttttgccctttattttggttaagaaaacaaatgagtagtttattttcctgagaagcacaaatgcagtgtttgtcagggtttaatgagtgttgtgcatattgtcatggttccttttgggagcttactgcacattagggcctgcattgatttctttccaggacaggcttcggttggcctgaaggtagacgcaggaatcaagttatgcctcttcatcatatgaggccatgaggctaccattatcaaggacattaatgagttcattgatttggagtgacctttggaaagaataccccaacagctgaaaagtagaaatcccataattctaccaaatggaggaaagattcataatatctgatgttgcttttctgcctgcctgagctcttccctgggccctggggccttacagggtgacccttccctctggtatgatggatgggggtggggtcgtaaatgtgcagaggaaaagcatttcagagacaggcacacaaggtgccatcagatgacctcagttaatatgacagatcctgacctattgtgttcttacctccctaaaatgagccaggaagaacaagagtcatgatgtctatgtggatttttttagacatcctcatcacttatcctaagctgcaatgaaatccttttaaatgccataatattaatgtagcccagtaaaaatatagtagcttgaataatgacatgcttttggaggtactgctgatgtggagatacataaaacaccatcctggaaaaaaacaataacaccggctttatatttgggtttcccttcacaagcctgttgtgaatttcctcccgattagggaggccagcagtaagagagcccagccttccgtttctgtttcttctgataaaattgtgagaatctcaccaggggtttagctacattaacatcaaagacacagcccaggggtaaccggatttggaaaatggaaaaagcaaacattttactattcccagagaaactgcctccctctttagcagtggcccaattttctgctgtaatatttcctatctgaatacctctattagtgatgattcaaggagaattttacctcttaggatcattgagttcaggtcgaaggatgattatcttctttctgtattttggctaaacgtgaacaattttctgcccacatgaaatatcaaaggacataaaccaaccactttacatgaaacattggctgtaattcttcactgccacaactgggtctgggcatcatagatcacgcaagacttgggctttaagaagcactccctccccaggcccctgcagagatggtttctgctgttgagatgcttggggagattcctgcactgtccctcttggggtgttaagtgctgcagtaggcgcttagggcctgaggctgtagctacacacacggttttgcctggggaagtagagaaggtttcagaaaggaggttgtgatttaagaaaacctttgcattttagagaggggaaaagagattataggtacagccaaccaaattagacaaggctgcccttaagcacgtttcagcaaaccagaactaagagcagattggatgccgtattctcatgtggggagggagggagagctagcacagctgtcggggggacctgagggtcatgctgtggggggcctctgctttgtgcactcttgactatagaagttaaccttccctttctgtggcacttctattgtgattttattgctcctcactgagcattttccagacatctgctatgctgtggctgctatcttgcggagacctgagtctgccctcaaagagcttatgagtaaaaggaatgagataaacattaaaataatgtgaaatttaaaaaaaacctagagtcacctgaaagcctcatctttgattttaaaagtgccagagagttgcagaattaaagaagcatttctttaacattcactgaaaagaaattcgtgggaccaaatgaaaagtataaaaggaacatttttctgtctgttatcatctacctagctatctgtctttgtatgtatcatctaatcttctatttatattgcttttagtaaataagaacctcattttaaacactggaaagtattctcagctcagaacgtgcacatcagactggaattagaaaggcacagagatgtcatgtttttaccatgctatatttttgggagtgaattaactgagaaataggaagagagggccctggtctctttctttttaaaaatcattaattatgttatactttttccatttaagtctatcgctcactaaattaggttttgcatgttaccccgctgccacctgaaagtaattaaaagctggttgtttacagctctggagagcccctgtgtgacaccaagaatgggggtcgtgtaaggcgaggggcacagcctgagtctccaaacagctgccagcaaggctccaaagcagccacaatagcagctagtctgcagggcctcagcctgccaggaggagacctgcacccattctgaaagctgcaaactgtgtattgtggagtacaacccaacacagagaagtacgcttttgacttttgaactaccaaaacaagtagatagacacatagagataggtatgttaatattttttctttaaaaaagaaaacaagaaaagaaagcattggggcaaatttagcccagaggatatcaggaggggtgtgtgtacatgtgtgtgatgtgcgtgtccacatatgtgtgtggtgtttggtgtggtgtgtgcatacgtgtgtgtggtgcatgatgtgtgtttgtatgtgtgtgtagtgtgtgtggtgtgtgtgtggcatgtggggtgtgtactctgtgtatatgtggtgtgtgtgtgtgccgtgtatggtgtgtgagctctgtatgtgtgtggggtgtgtgtgtggagtgtgtgctgtgtgtggtgtgtgagctctgtgtgtgtgtgtgtgtgtgtggagtacgtgctatgtggtgtgtgtgctctgtatgtgtgtgtgtgtgatatatgcagggggtgtgtgtgatgtgtgtgctctgtatctgtgtgttgtgtatgtgtgtgtaaaacctcatttgttgggccactcagtcacactaaaatcccccttgatttcctattttaagtttctggaatatgacttgattgcagcgctgactcaggttagctgggtggcctagggaaaggcgtttctatctctctctgtttttgtttttgtttttgtttttgtttgcctcagtttcctcccatggatatgcagtgatttctctagtcctctcccacaatacaatgccaggatattaaaattccaaattgaatattccacttcttaagccaactgctgtcaaagttattttttcactttcttagatttaatcttgcaggatgttacatgcccatgtcaaaggtccccaagcccaccctcaggtttggtgatctgccaggaagactcagcatgtagctgcatccatggctgtgacttaatacaggagaaggctatggagcaaaagcagcaaaggcaaaaggcacatgaggtgacattcagaggaaagcaggccccagctctcaggggtcttctccctgtggaatcactaggaagcacttaatttctccagcaatgagtcatgataagaggtgcaatgttgtctaccaggggagcaggagagctcctggagactcagtggccaaggtttcctttgggggcaggtcacgtaggcaccctggtatgtttggtatgtgccaaagttccagactccccaaggaaggcaggtgctcatcatgaactgtattgcttatgcagttcaggcagtgagccactctaagggtggtgggaacgctgccaatatcctagttcccagataccagccaagggacagtcctgcaagcagcccttcataagactgacagtctcagacctactgtgttaactcttctctgtgccatgcaactttttaaatgatgttggctcatcttcattttcatacattcaacgatcactttgcatatgctcatcatgaaatgctggagaaagcaaatgaagaaaatctatgctttatgtactttattgccttgtacccaagtatttcaagccttaagaaaggtctcatcccaaattattttaaggtctgaaaacacattgactcatactcttcccttgctccacctaagtgtaaatggagttcattttatattctgccattaaggatcttctgctttctctctctccccgtgatgtttggttctttctagacatgggaaacagatggccagctaagtcaatcagatgtaatttggacacaagcatattctctggtctgttgttcatctaagagttttcatttcaggaaaattcaagagaataacaggatcatttaggaaagaatattgtgtagtgataaccataatgctgttagattattattattatcgacaagctaaaatagatgtcacaaatcaagatttgcttagacaatgtgccacagtataagaaaacaggatttgagattgagaaatataatttttgactcagaataacttgctagctactcaagaagtcagtgtgaactcaaggtattgtcgagcagagataaaggtgggttggaccaggcttatggtgctgtgtcctttgctctgggctggagcaggtggaggaaggtctccttaagcagatgggttgcttggcctccagaaatccctcaggcggagctaccatggctgtcagccctttgtggctgtccttctgagcagatggggcaggatggagtaaaccatccagcagcccagacttcctctctcctcagcaaccgcgtcacctgtggaatcctcagtctaggagccaccccgcttcccttctccaccgtcagcctgtggagcgttcctgcagactgggcacattgagcatttatgccagtccggtttcttttttcttttttctttttttttgatggagtctcactctgtcacccaggctggagtgcagtgacgcgatctcggctcattgcaacctcttctccaccgagttcaagtgattctcctgcctcagcctccggagtagctgggactacaggcacctgccaccacacctggctatttttttttttttagtagagacagggttacaccatgttagccaggatggtctcgatctcctgacctcgtgatctgcccgcctcggcctcccaaagtgctgggattataggtgtgagccaccgtgcgtggcccggtcttaaccagctcttcactgattgtctggatgctcaggtgtttttgcgcccgcgtctgtatagctgaagaggtctttcccaagctttttctcagcatcctggagcaccccattctcaactctgctgcacctactctccagtgttcaaaggatcgtaacttttcactctgcaggggctgagaacagctttcttcagatgaccctttctacctccttcatggctcagccccacgttctctcccacaggaagagctgtcctctttccttccagcttagcctcccaccgtgctgccctcctggtccccttacctgctccggcgttctaggacctcttttcatcagctgtgccctctgttgcttcagacagcttctctttagtaattaccgtatttcttgtgacacaggtgctcaggtcccccagttttaaagaaacctttccctttgctaaattccatacttctttctttctctgtctttactttcttccttccttctttcttttttctttctctctctctgtcacacactcctttcattctttctctttcttctggcaaactgtttgagataatagtttatagtagtgagtattttgggctttgcctgttacaatctactgaaattcactacttcaagatcacccatgacttccaaatgttaaatcccaaggctgtctcctggtccagtttctctctgacctccctgttagatgtacacagttgacctacttcctctgttggttcctgtatttggcagctctggacgccaaaacaaaatatcacacactgggtggcttaaacaacagcaatttatttccttatagtcctggagcctagaagattgagatcaggctgccagcatggtcaggttctgatgggggcctcatcctggcgtgcagatggacgccttcctgctgtccttacatgactgactttctcatgtttcttcttgcaaggacactaattctatccgattaggggccacccttatgacccgatttaaccttaattactttcatactccaaattacttctcttagtaattactgtatttcttgtgacacaggtgctcaggtctcccttcccttcccttcccttcccttcccttcccttcccttcccttcccttcccttcccttcccttcccttccctcccctcccctcccctctccttccctcccctcccccccccctccgctcccttcccctcccctcccctcccctcccttcccctccgctcccttcccctccgctcccttcccctcccctcccctccccctccgctcccttcccttcccttcctctttctttctctctctttctctttctctttctttctttctctctttctctctctctttctctcttctacctttattttcttccttccttttctttctttctttcttttttctttttctttctctctctttctctctttctttggggttagggcttcatcatctacaactttaggggacacaaggcagttcatagcagttgctctcctttggtttgtatccaactacactgcctggttgatcttctctctgaatatttcggtgctatctctttccttcagtttgcatcttcccctctcagaaatgtatgtcaatctaaaagtccaatcccatccactttctgtattggtcatttcatcatcttccagggcttcatccatgacttgcacctgtgtgaccccaacttcggacctgccttctctcctggtcctgcttattcactcccccgcatccctctggccacctccaacaaaggaaaccttccccatgaccacaaaggaatttccctttgatttattcatttatttttcaatatcatgactgtattagtttcctaggactacaaaaaaaaaataccatgaactgactggtttcaaacaatagaaatttatttcctcacagttctgaagtctgcaaatccaaagtcacagcgtcagcagggctgtgctgactcagagggctgcggggagggtctctgtcagtactctggggagggtccctgtcaggcctcccagcacctggtgttgcctgcggtccttggctccttggcatccttgacttgcagaagtctcactccatccagtccctccctctagcgacatgtgacttttgccctgtgtgtgtctttgcatttcttctcctcttctaataaagccaacagtcatattggatgaagggcccaccttatttcagtatgacctcatggtaacttaaatgattacatctaccacaaccctgtttccaaataaggtcacattctgaggctccagaaaggacatttttgggggaagctatttaacccactatgattacaaattcttccaattctttatttgccctctctcacacattttatatctttccatctcctgctggacacacagtagacaactgataaatatatactcaatgagattcttaaaaaaaaaaaaaaagcatttttaagggaaggaaacaaaaagcagacagccccatcagggtagccaggagtgctggtgtgccaggtcctgtgggtccctgcagccctgtccccggcggcgccagcatccagctggcagccacaccaccagctgccgctgtcccagctgcaagtagcctggtctgtgtcagaacgggctgggggccagtaggggacaggatccaggcagtcctggaccaagcacaggggcggcaggcaagctgcttcacctgcatttcagatcctcactttcgggtgccacggtttattgggcatcttcaagtcctgtgtttccttcctcaaaaggaaaagggggaaatttgttaatggacaaacgactcatcagtttcccaagtgattagtagtctgaaaacatgtgcatgaaaaaattgcctcaaaagttacccttgattacaaaatcaattccaaacaaactgaatttttattggataaactgtcacctgtggttgaaacttcaacaactagattctatttgcaaagttgtattgactgtccaaggctcatgtatgggggaagtaatgagagtatttacagaatatttcagtgtgtgtagttcctgaaaatacagttattccaaaattaattccaaactaactgaatttttattggctaaatcgtcacctgtggttgaaacttcaacaactaaattctatttgcaaagttgcattgactctccaaggctcatgtatgggagaagtaatgagagtatttacagaatatttgagtgtgtgtagttcctgaaaatacaatgatgctgctgaaaatattggctgtccagaattggactttatgagcaacagaaaatccacagcacacactgctctgcagtagagcagagtcaaaatgttctttgaaaagaagctataaacagatacagtaaataagcaaaaatacacagatcctgtgtgctcttagaggtggtttcaggtttctgcatgtctttcattttgccagcagcgcacagcagggcttgggtttgcactcagaggagcctggctttgggtccctactgcacagttgtgagaccttccatagttaaatacctctctgtggacctgggtactgtgtttttataaagatgaagagtgccataactgcagtttcaggccaagtgaggtgctccatgaattggaacatagctaagtaattctggacctctaggtgtgcatttctctatagagcctgtagatagtgtggagcctgaagccagtgtctaggtccataccccatattcaacctggaccaagttacgtaaccttgagttagtcatataaccttgctatgcctcaatttcctcaactgtaaaatggaaataggaataaaaataacattatagtaagattgttataagaattaaatgaattaatataggtaaagttcttagcacagtgcttgacattaatgtttgtcattgtccttcttcttcttattattattatcattatcttctgtctaaagtgtttgtatcccagaaaccagaaggtcaggacaccgtggtttcaaaacaaataggccgttgtttgtgtgaggcttgttaggaagtaaaagaaaagtagttctatttaagaattgctaaaatgcaaggtatgctgaagaagtcatggggaaataatccaaaatccttcaatttcaacataaaagcattagaatgctattgaactaatagtctgtaggattttaaaataaacaactctttacttatttattaaaacgtttatttttcttaaatagcaaaagtatgatataaaatgacaataaggcagaatgaaaggatcttatattttgccttaaccatcacagctaaatcagagtatgtatttgcagtaaacattagtatttacattaaaatacttgtagcacatgtcagttattgaatagctaacaattctatggcatgcacatgtcaggttatacctaaaaacttctcgacaaccccattaagtaattgcttttgtcggccccactttacagatgagaaggctgaggcagagagagcttcagtaagtgacccaaggtcctttcttgaaattctccctctctagaagatagagattttgccttttcttaaactttctttcagtttcccatattatgtacgtgcataagagccaacaaatattgtcgactgaatgataacattaccattccagacacatagtagaagcttaatacatgtttatggagtgaatcttgaataagaaacttttccatgagagtggtggtgttatttccttttaaattcttcttaatgctttaataagagcttttgcttttctatatttttttctactactctaaaatcaaatttcacatcagcctctcctcccaaggcaaagagtgcctgtgttggccaatcaggggcagcctgggatttcatagctgacatctcctacgtgatgccgttctgagggaaatcgacatttcaaattcccagtatttattattcccaaaacaaaagctgtcttcttttattttcatgaaatgattttattgttggaaccacctacagctttacactgcagcatttgttaaaaagcaggacagtgcaagtcaaggcgaggctgacatgccgagaccttcagaggcgcgttacagcatttcctgatgcactgaatccatagccacaccacgagcctcagactttactttcagttttttatctaaagggttatacacatttggtgagcacagagtgtcaacctgccatggatagcttttgtgtgtgagggcatgttgtttcaaatagtgatcaatatgcttcaccaatttatgatgatggatctaagaatggtagaatttctgtgtggagaagcttcagggtgtctttttgagctggatactggagccctggaaaggttacatgggggaaagggatggcaaaaatgacagctgctgagccaatcagatcacccacacgcgcccatatgaggatgtaaatatcacctagatcagcctcccatctctatcactggctccgatttctcatcggagaattattttatagatgaagaaagcacccagatgtgaaaagtcacctgagcagtgaatggcggtgcagggactccaacctgggattttgtggtggttgtgtctgcactagttctgtgttcagttgaaaatttctccattactgtcatttaagcacttattctggataaggcaatgcttttaaagttgccattttaaaaattatatgacctgttttaaaaagacacaaaagagatagaaacacgccagatataacctaattataatcagtaggcttattatactgaaggaattacaaagacttatttttctgaaagaagttcattgaaaactgtacttcccaaaatgattcattttgaaataaacttataactgagctttacttcaatatcaaatatttaaaatatactttaatgcaaataatatgttgtatatctgaaaatgtttacctgtaatttctgaaaaaaaagtattatatataaatattgtcttagattgtttgggctgcattaacaagttaccatgcattgggtggcttataaacgacagaaatttatttctcagagctctggaggctgggaattctaagatcaaggaggtgggtagatttggtgtctggtgagggttctcttcctggttcatagacagctgtcttctcattttctcacatggcagaagaggcgaatggtgtctctggggtctctttttagaagggccctaacctcattcatgagggctccaccctcacgacctaatcaccctccaaaggatccacctcccgatagcatcacattgaggtttaggtttcaacatatgaattttgggaggcagggaaatagatcttcagtcgatatacatatttttttaatagatggaaatatccttaggccaatgtttcttgactttttggggggatcatggacatgttgagtaagtaataaaagctatggggcagtggatcttcagaagaacacaccagtatcgaaagctgcaacagtccaggccttttttgcttcctttcaaccttgtgactatctgcattccctcaccccccggctcccacttgtccttacccagattaaccagggattcatactccattaaaatgcctgatatagatgttggatcgtgtcttcctttttttcaacctaaattgcattttgaaaccttcagccacactcttttctctgatctcttatttgtcctggtttcctctgcttctttttatgcacacatttttttttatcctcctatgcccattgcattgtaccagtatctttcactacaattgttcttgtaccaggaaaagtaaagggtttttataaaaagccttcatcaagtcattttcaaactgcagatgatactaggaaagaaaggccatactgagattcccccccggctaattagatggtgaaatttttagttctcagcattgttatctgtttgaattgaaaccctatcattgaaaaagccaaatgaacttgaaattgaggagggccatttcccaaaacggaacgcagccaggctgaatccctcggtggagagccagggagcacgaggcccggatgcacgtgactcgtttccacagttctgatttccaagcgaagtaatttgttctttaaaaaagttattctaggattcaagactttaaaaaaaatctgtattgccaaatgcttaccatgcatgatgaaatattgaagaaaggtgtatctcagccttgcaggtaatttttaaatgatccacaaggatttattcaaggtcagtaaattctgtgttcgaactttccatgtcagtctgtgtcccacactgtgtccccatcaagtcaattcctctgatgctgaatctactctattccttgcctctaagtaaaaaaatttttaaaaattaaaaaacaaaacaaaacaaaaaaacaagcaaacaaaagaacaatacggcaatcgaagtctcaagcatttcctcttttactgaattcgacacaattccatcgctaagtagagaaaacctgaacatcctattgctggccgtgcctcccagggttctccagtaaaccttttccatgaaagcctgaagtccatttcagatgcaaaacatgcagaacctctgggctccgcgaggcctgatgcatgactttgataggactctgcacatgcttagttgatggtcctgaacatgtgtattttcctgaatttcttgtgctttttttactggctttgacttgttgacataagatgaatgtttctctcttgttttatcaaaatatttaagtgtttttagttttgtattgagatttttaaaaacaaagcttttcttgctagtaaggatatggatgattactttcttttcaagaaaaatggtgaaactggaaaagtaatttcatgtatttaaaatatacacttgttgcatagttattgatcagtttataaattttacacctttttggtggtgggaaaaatatattcatagtgacttctatcttaaattctggatctaagacgatgctgctttttactaatagtggctatagagtatatgtgttcttgtaaaatggttatgcagaaggagaataggaaggactatagatatgtgattaaagatatttctcttttgaagggttagttaaattgaggaggcggcacgagggacaaacattgtaaactctgtgtaacagcaaggatattcaaggtgacaaggatcagaacctctgtgaaggttcagtaaaattatttgtgcacatcaggttattatataggatgtaaaaatccagttttatggcaagatttatttgtttatttgtgactaacatatacgacctgaatttaaaaactagaggcaacactcatagcaatttagaatgcagcttttcttgtgatttaaattggacttatttttctttagtctccaaccctttcttagaagaattatggtggaacagaagctgtaaattagggacagttatttgaacctagttacagaaacgaagttattggcgtggggattctataggagggactctacattggatggaaatgaaggaataactggaagaagaaaggagcaaataggcccaagtatacatttcactgtgtgaacccataattctctctgatagctgcatgattaattcaaagatttattgatttttcccttctctactccagcctgctgacctggttttgttgacaggtttgtgtggatcaagccaatctgacagatgaaagtgtgctaccatattagtccccgtggtctggggcaaatattttatacagtgtccttatcaacagtaaccgaacacatgtgaggcatccgtcaacactccttcccatgccatgccatgaaatagactcagagatgccagccccacagcagaagcagctgggattattcgttttaatgaacatgcatcgtgtgtacgtgtgtgcgcgtgcatgtgtgtgtgtgtgtgtttatataatgaggtgggagtgtggaagttatggcatttttactcttagtaacaaatattaactgacagttagcttttaaaaatacctttatgggccgggcgcggtggctcacacctgtaatcccagcactttgggaagccaaggcgggtggatcaggaggtcaagaccatcctggctaacacggtgaaaccccgtctctactaaaatacaaaagattagccgggcgtggtggcaggcgcctgtagtcccaactacccgggaggctgaggcaggagaatgccatgaacctgggaggcggagcttgcagtgagccgagatcgcgccactgcactccagcctgggagacaaagcgagactccgtctcaaaaaaaaaaaaaaaaaagaaaaagaaaaagaaaaagaaaatacctttaatgatacctgagatttacttcaaaacaatccattgccaggggtgaggttgtagcctgaattgataatttctgaagctgggggatggtacatggaggtttattatactcgttatatccttcatgtgtgtttaaaatattctataatgaaaagttgaggaaaaacacctataagacaaatcatattttttacttgaaacttcagattacatgtttaaacatgagcaattggcacatgaccaagccaggaataggcagattataaatgtcatattttaaaaattaatgctacaacaactgaagcatttttctgttggttatgagctctaaattctggccaaagactagaaccacaaataaaatggtcctttaagactagtgaatcatctccaagttgagtgtattccttctcagctaataaaatgagatatttttgaccaacatttctcaaactgtgtccatggagagattaggaagatagggaaaagattatgtggattctggttcaaaaaattttaggaaataatacattaagcaatagcaacccagttccatgcagcacgaatgtcaaagtgattgtggccactttttaaaaccaattaaattagtttatttttatttttattttctctttttagatgtattagtccattctcacattgctgtaaagaaatacctgaggctgggtaatttataaggaaaagagatttaaccggctcacggttctgcaggctatagaggaagcatggtgccagcagctgcttctggggaggcctcagggagcttttactcatggtggaagtcagagctggagcagaaagttcacatggtaaaaacagaagcaagagagagtgagggaggagctgcatacttttaaacaaccaggtcccatgagaacttaccatctgaaaaatattgtggatagtgctaaactattcatgggaaatccacccccatgatctaatcacctccccaggccccacttccaacattagggattacagttctacatgacagctgggcagtgacacagatccaagccataccaccagaccactcatgttattctatagaatataatttagaaaaaactacttccaacgtaaggccactagaggtgatttgcataaaattgaggttgtttaaggccttgagttcaacaattcagggttaaatatgagttagatgttttcataggaccaaacaacatttataggtcttgaataaatctgaaatttctacttttataaagtctaatatgtagatacactgggtttcattggattctaattccattttttgtattttggggggggcatcatttttatctttactaccgtaaaacaagacaccatcacagccaactccaaatggccagctgtgaagtggaaggaaagatggaacaagaggcaaccaaccatgtgtgggtgctcaggtggaggggactgtggttggtggaagacccctaagtggagtgagcttggatagggagtcaggatgggaggtggccagggaagggatggggcagggccagcctgcatatgaagggccttcctggttaaggcaatagctttggatttttatgcagggataatggcaaactgttgaattctgggctggggattgatgtgactgctgttgctgtgtggagaaaagtgcgggggagagcaaacataccattagatgactagtaggaggctggtggagactgacttgagtggcagacatggggacagagaaaaaaaggacagatgtgagagatgtttggggaagctttggtatgttggctgatagattagatgtgggggtgagagaaagacagtcatcaaggatgattcaggtaaggaatttagtgcatgttggtaccatcaataggtgtggaaactctattatttaaggttatcaatcagaaattgaatagcattaataataggcaaagccctttaggcactctgttcttggtgtatatgtgtgtgcggaggatgtcctgtgagccacttaggctcactataaatatctttctgaagccttccttgaatatactactctggcctcctacctttgctcaagctgttttcttttttctgtttcaccttcagctttatcttactcatgctaggtcagacttatcactgacttcactgcatttttgttggctgatttccagttagtcaaaataaaagaaagtggatagttttggcctttgaagcaaaaagagacacagggacctctctttccagcttccaactccggatatagcagttgatggtcgacatctcacagtaattattaggcactataattttgctaaatttacttaagctaaactaaagaccaccaagagcaccttctacggactgatgttatgtccctctctaaaagccatatatgttgaagccctaacccccaatgtgactgtatttggaagtgaggcacttaaggaagtaattaagattaaatgagggcatcagggcagtacctaacccaataggactggtgtccttataagaagtgggagagacaccagagagcttgctctttctctctctgccatgtgaggacacagaaggtggctgtctgcaagtttggaagagagccttcaccagatacacagtggctggaaacttgatttcggactctggcctccagaactgtgaaaatataactttctgttgtctaagccatcctgcctgtggtattttttgcagcagcctaagatgactaatacagcacccttctgctcttctgtctgactgtggtttcttggagaactgctgtcttatattcttcttacttccaatggtcattcaatttccatacggtttccatgtagtctaatgtcagttcatttttataaatttaaactatttttccatttttcccatagtcatcctttttttttttttttttttgtttaaggaatcatcttgctctgtttcctaggctggagtgcagtagtgcaatctcggctcactgcaacctccacctcccagtttcatgcaattctcttgcctcagcctcccaagtagctgggactacaggcacacaccacccaccacacctggctaatttttgtatttttaatagagacggtgcggggggggagtttcactatgttgaccaggctggtctcgaactcctggcctcgtgatccacccacctcagcctcccaaactgctgggattacaggcatgagccactgtgccaggcctctttgttcatgttagtgtatggagacttttttatttgttcaggctagtctgttcgccttttcttcctttgaagaaattatctgttctccttataagttttacagtgttcaaactttggatcatgtctttttctctctttgatctctttctaaatatccctttatttaaaactgtgcatggattttctcctaaaatcatgtggtgaggaaaatgaacttttacatttcttcaggaaagtaaacctggtcaaagactacagttgggagaaattttagacactcacgtatgtgactagactgtggatgtgaatggtgtctcgttaagcttgtctcaggctttcatatggcaaagtagtatttttaagttctttttaggtcctgcctttacctcaggatgcattttcttataatctgattacaatattttttaatggagactattttctcttgtacaagttatatgacaaaagtacatttggcttgtcttctgtttgtttgagttgattgtgttctgattaggaatgctaagtcacctatgcaaaagcaactgagaactaacttaaaaacatgaattattggggaaatgtttgtacacccatgttcatagcagcattttttgcaatcgccaaaagataggaacagcccaaatatccatcacccaatgaatgagtaatgcaaatgtggtacataacattccctggaggatttgtcagtcttgaaaagaaagagaactctgacatatgccacaacaatcttgagggtattacgctaagtgaaataagcgtgtcacaaaaagacaaatactatatgattccacttatatgaggtatctaaagtagtcacttttttttttttttgagacggagtctcgctctgtcaccaggctggagtgcaatggcgcgatctcggctcactgcaacctccgcctcccgggttcaagcgattcccctgcctcagcctcctgggtagctgggactacaggcacacgccaccacacccagctaattttttttttgttttagtagagatgaggcttcaccatgttggccaggatggtcttgataagcagtcaaatttacagaggcagaaagttagaacggtggttaccaggggctggaaggaaagagaaattgagaaattgtttaataagtaccgagttaacaatactgaactgtcctctaaaaatgggtaagatagtaagttttatgttacatgtactttaccacaaataacttaaaaaacgtattgcacctcttctcttaaaatagctgcatgggaaaattgattttatttgtaagtaaagacctaggtgaattaacttgaactagtactatattgtgacattgtattttataaacaacttccaaaatcataatcataattattttgtcctggtatttttttaaaggatgtgtgtgatggtattgaatttggacttttttttttattatagccatatgttgaaaaaaatcaagccttagaaaatgaaaagtatattgtaggcttaaaaattataataacatggtcgggcgcagtagctcatgcctgtaatctcagcactttgggaggcctaggcgggcagattacctgagttcgagatgagccctgccaacatgatgaaaccccatctctactaaaaatacagaaattaaccaggcgtggtggcacacgcctgtaatcccagctacttgggaggctgaggcaggagaattgcttgagcccgggagatggaggttgcagtgagccaagatcaagctgctgtactctgacagagcgagactctgtctcaaaaaaaaaaaaaaatatatataacaacatttgggaaaatagaatgatagtaattttatctgtctttatattctttaacactttggtgactgaattatagacaactagtgtataagctacaggaaagcagagattttggtctgttctgttaatttctagaatagtaactggcacataggaactccatgactcttcatttaatgagtacacgttgagagtatccaagtactaattactctttgggcacgtggattgtggaagtgtggagaccagtccacagttctcctagatataaggagctttccctgtgtctgttgatcacataattattcatcagtgagctctttgttgcttttgtatcttagggtaaataatttaaacagatcatatagataagacactgaaaatctctccactgagaggtggagagattcgtctagggtctcaaaataaatgactaacagaattgttctctgttcaggacactaagtgatgcaagaaatatttagtgaccaccgactctgtgaaggtcttgagcttggctttgtgaatatagctatgaataagagaaatacgcaatccctgcactcaaggaatttattatctggtgtgtgtgtgtgtttggcacggaggtgatataactgcttcctgaactcaatacaatcttttcattacagagcctcattttagccccaatttctgtatcttttctttgtttttttcccaatcactatcttttgactggactatactactgaaaggaagtggagtccttaggcatctctgggtggtctggagtgatctcatcttccaggaaagctgttacacagacgttagtttctgaaaatgatatgacatgcagctcactgtaatacaatctattaattcaacagataaagttttatgttctaatctcccagaatagtacttaaacagtttagtgcacatgaatcacccaggaatcctgttaaataaagcagattctgattgagtagcttggtgtggggcctaggattctgcatttctaatgagctcccaggtgttgctgaatctgctggtccaaggctggtattgtcagtgacaaggctgcaggttcttagccctggttgttcattacaaccccctgggtggatttttacaaataccaatgcccttagagatttgctttaattggtctgggcttgggctccagcattcatattttgaaaaactttccaagtgagttttatgttctaccagcactgaagaccacttccctgcacaaacacaactgatgctgcctgtcattgtgtgtaactgaatccactgatgtgagttggtgcatatcagtaccttttataaatgcaaggaaggctggaggctggggaaattgtcataagacagcacccagtgcagggactagtgtacagcagtgtgtttgctgaataagtgagtgaggcaacgagtcattttcagacactgtagaggatggctagtgactggatcccagtgctgttgcctggagctctagcaactgtatttggtatctctaaacatgctggctatgggatagcagagttaatagaatgagactggggccttctacttccagataaaaatttggaaaggtattagaaggaaggtactggggaaataagttttgatctatgatagataagataattgaaaaccaaaccaaagaaattaaattcagagtggagaggtgtattagtccattctcacactgttatgaagaaatgcctgagactgggtaatttataaagaaaagaggtttaattgactcacagtttcacatggctggggaggcctcaggaaacatagaatcatggcagaaaacaaagcaaacacatccttcttcacatggcgacaggagagacaagtgccaagcaaaagcggggaaaagccccttataaaaccatcagttatcatgaggactcactcactatcacgagaatagcatgggggtaactgcccccatgattcaattacctcccacctggctcctcccacaacatgtggggattatgggaactacaagatgagatgttggtgaggacacagccaagccatatcaagaggcataaatcgaaggtagccttccagggactgaggtcagatttgtcccaagttagacactttgggcacatattttcaacagacattccacaaaatatgcaagtatttattttttgatagtatgtttaaatacaaatagaaatcaagccttaaaaatgactcgctgatgaaactacatttctcctgctcgggactgcatttcagatactgtccatttgcatctgggtccatgatgtgctgttgaaataacatgaactcagcttgtaggtgaaggtggggagggaaacatgcatttttccatctgaacagaaagtgtgttctggcttttttctgagatattatttttattgaattttaagacccacacaggaagtggctttcacttggtttcatcttcctgatcagtgcatgttggggacaaaggagagaggagggagttaacctggataagtctgctgcttcttcgggagagtggggcatcccaccaacctgctgcccatgttgctttgtggggatacatgaagcagcttctagaaaggcttctctaggagcttggtgaggctgtgcaatgccttttttgcaaaacgcttgctgttcactaatggagcagatgaaataataaagccaaccaaggaagcaacttaatggggaactaaccagccacagtggcttttggaactcttgtgccttgctgcacatcactttgaagtagtctgtggagtccatgcttctgatccttggaacatttggttcatttttatgtcattgttgtctagcgctaaccgcaactggtcccatagacctgaagtagcccaggtgcaggggcaaagcagtggccaggtgtgagtgctgagggcctaaatatttcaagtacaaaacgcccaggaaaacaaccaccgggggctttaccatacttataaaaaggaatccttccctctgaaagcctccagcctgactgtaggcagaagcagaagcagccattgcccatgcaaggtgaggaagaacaggtgttggtgaacagagtgggctcaggtcatcatttgtgtggcaaaattctatcagggatgaaagtatcagcaatgggaccacctggaacccaagctctgccactttcttgctatgtgatcctgggtaagttatttagcccttctgttccgcggttttctcctctggaaaatgatgaggatgatactactctgctcatagggttgttttaagggttaaatgaggtactgcatagaaaacactcatctcagggctgggcatgcacagtgcatgggtgtagctatcatcatcctcctcatatttagaatgcttttctgtggccacccatcatcagtatgtgcctatcttcatcagcagtgaagaggacagaagcttctttctcccttcctggcatgctggagatgtggttggtctcctcaggttaccattaaattgttggcagtccccactgagagtagggatgcagccaactccacaggcacctgaggagctggccctctagcaggtgtcagccaggagagacatttaccaaactgaagttggggaaaagcctgagctgattccacactctaagtcaccttagggcccaaagaacaggtggcatgagatactcagggaatgctatggcagcgtgcctaaccatggttctgcaatcttcacacccgaggtcatggcagcggacaatttctgtcttctggataagatgggggtgtatctgtctgtgagcattcattcactgattcattcaaagtggatggattgggcattgccatggaccagacccggcacagatggggtgcccagggtggaacggtgagcagtagtgccagctgtgtctgtgctcatgggcctatggtcttggggaagacctcaagtaatcatgtaaataatgacctgcttacaattgtgagacctgctggaaatgaacaacaggagtgggggctgtacggggaatttcaggggacctggcctgtcagaggtcagggaatttatgccctggaaagtgacaagttgtcctttagattggttaaagaaaaatgaaagtgcggagaggacattccaggcaaggggaacaggtgcagtgggcactcacagaaggccaaggggacagccctgttccacaacagcctgctcagagtccagtttgctccttgctcctgattggagatttttcacatactgtctcccagcagaggattctgtccacaggtattgacagggcctggctggtctcttcttgtcattcaagttgtagttcaggaaggatgcacccagaaggctgcttttgactactcactctgaatttgccacctccccatgcccagcctgcctctgtgttttctttgaaattctgccgttcctttattcctttgcttgctatttataaagaaaagaggtttaattggctcccagttctgcatgctgtaaaagcctggcaccaacatgtgctcagcttctggtgagggtctcaggaagcttgcaatcatggcagaaggtgaagcaggagcacgcacaccacacggggaaagcaggaacaagagggagagaagaggaggttccagactcttaaacaaccagatctcctgtgaacgaactgagtgagaactcacttatcaccaaggggatgggaggtccacctccaggacctggtcacctcccaccagaccccacctccaacactgggaatcacatttccacatgagatttggaggggacaaacatccaagccctatcacctgtgtaccatttgttgcttctcctctgaacaaaagtcctcaaaataggttcttcgtcacatccactgttgtcccttattttcaggacactgtctgacaatctgacaaggaagtagtgggcactccacgtctgtggagcaatggacagtggctcccagtctggccaaatttccctaacatgaaagcatggaacacttcctctcacaggtcaaacgcgtggaatgaatttgcaatgcaattctcggcacagctgactttccttgttgcttctgctggttttgatcactttccctggggtgctgtgccatcaggagcaggggcctcctctttcctctcctgtcggtcctctccaagtgatctgcaacttcatcccggggggaaacagggcagggaacttcctcctcaatttctgatattgcaaggtagcaaactcacacaggccttgataacaataaatgaagagtcaggtctttacaaatatgatgagaaaatacaatggaagtcccagtggggagtccccacttactccttccatgccaatacagatctccctacagactttaccactggttctatatatatgcgatgccagtgggaaggtatttctcagccgttagaataatccatttcctttatcccggactatggataagaggacatttgcaggagaggggagacacttaggaagaaaagactggctttgtgaatagaaatacattatttgtgcatatgttgtagctcgactagactttgagcagactgatatctgaaaacatatttataagcctgttataaactcataattctaaaatattgaattttatttattttgcatctataaactgagttttgaatttgtgcagtaatttgcattattcagaactcttgattgcaagtgacaaacagaaatcaaaaaaaagtcttattggctcacagaactgaaaactccaggagtaactgccttcaggcccagaagcatcaaggtgtccagaaactctgacaggagcacctctcactcttgctgtcagtcttactgctcttggagtactctggtttagattggctccttggcatacctagcatggcacgttgcacacaaccccagtgacagtagctcagtagccagggggaaagagtcttctttctccaaaatccctgagaagggtcatgtcacatgcctatctgtgaacgagtcaccatgtctaggggcacagaggtgatgaccttggtctcatgcccatgagggatggctcctcaaaggaaaacccaagtgctcttattctaagagggagaattggatgcccagagacaaagtctatagatgtacgtggtccagtgttgaagcggtgggaggagagtgccggcaacacaggcaattccacgttgtgtgcgactggcctgtgcatatggaggtgttcagtgacctggccctggacactcctgctaacaggacacacacatactctcttacacacatacatgtccacacacaccacacacacacacatatacaccccccccacacacacactttgacatacactcacatgcttatattccccccacaccatgcacagacatacactcacatgcacatatgtcatacacacaccacacacactgacatacatacacttaacatgcatacatgcacacaccacatgacatacactcacacatacacaccacacacatacatactacacatactggcatacacacaggtgcgcacacacacacactcacatgtgcacacacacacacatcattgacaactatgaaaagcccctgcatacctcagagcccctcaagctgggcttctgatgacacctcaggcactctcccctttttattttgtttcccatttacttcctaccttaccctgttcaggctgccgtaataaagtttgatggactgcgtcgctgaaactacaacagttcatttctcatggctctggaggctggaagtctgagatcaagatgcccgcagggtgctggtgagggccctcttcctggtggcagaagccgacttctccttctttctttgcctggcagggagcagggaaggaagtgagtggtcttgtggctctctgagggcactgattccattctgccccacctcccatagcatcatgttggggaacagggttccagcatattaatttaggggacacaaacatccagcccctaacacttccattctcattaattgccttcaaagagagctaagctaatcctaatggtaactttggcataaagcaaaactttgagaagatgacatctgatatctgctgttcaatgcatgcttgttgggagaagagtgttaagatttggactttgcgtcacttatggccaaaataggacgctcctgtatgtctgcacttgaatttaaatatgccagtctcaatataaagcacggaactcatgctgtttaagcaagagcacatattaaggctggcatgtctgtcaagataataattttgatagaggattaaaaaaaggaaaaaaatgtagagaactgaaggtaaaagatagccaggattagacctttcaatattaacagtgaactttctttagatatttcttacataatcatcaatgcttataaattctagtgcttctgtcttttcacagtgttgtgtttttgtttgtttgtttgtttgttttaacaacgtaatgtgcttattcctcaggcttcaggtaacctctgtaattacacacccagtgctgatgcccacgggctgccacaaggctgggcatgttactttatgctctaaccctatgtgttcaataagtactttgaaaaaaataatatcttgctaggcatattttaaatcataaaaatctcaattttagggttttcttccctcaaatgttaatttactatattatttacacttatttgccaaacagggaacttttgctcaaagaaacaggtgcagttttagaagctgaaattaaacacctctctattctcatattgccttttttccctttggacacgccccaaagcagacatcctgcttacaaaagagagcttaatggcctccctcctgctctccctgcctgaagtctttctagaatttggaaatatgtccattttgttagggcaatctgttagtgttaatgattttatcaatctaaactccactaaaagaagcaaatcaacacaatgctaataaattctgtttgttttctaatcccaagaagacacaataaattaacatacatttttaattttaattataaaacctttcaaatagggatgttgtctctcttatcctcactgtcattcttgtgcctggtacagagcagatattttgtgagggttatttttgttgtcgaataattgtattttaaatacacagaaaaggacagagagtcacaaaaacaaaaagcacgaaagaaaacaaaaaccaggtacttaagcccaacatagagtcagatgtttatgctttgccacatttcattcattcctttttttatgaatacgagtgttagatagaattgaggtcccactcacattttctatacacatcttgaaacctctgcaacgtatttgtgaatctgtaaaccatagaaactaacacagtgtatttttcaaatgcatataaatgatatcgtgcatgctaagatttttcttagatttcctataaatcatttcaatcaaactctccctacttttctgtggaaactatgtaacaaaatgctctatttccggaagcctccaggccaagggtgagtgagcctggggtgttcaaatgtaatcagagtccaaaacaggcccttgcttgggctcaaactaaactgagttaagaaattagcctggaagggagagaaggtgatgtcagatcttaataggataacattgccatgagttctccttgcaatagaggaggctgcttttcttcagcagttattgagatgtatgtttcttttttcactaaatttctgttattgtcggttgattttgaccacaggttgttgtcttattgtcttgactgtcaaggacatataatggcagagggattcttaggtcagcagacatgctctcagcttaggcaagcctcaggggctgtatgtgtttcagaatttctcacattttagatagctatctaaaagtaaatgttaccatactctgcatgttttctacaccctcacggtggaatgtggggcagtaatgcttcaagatttcttcagcagaactgtggaatttttattctgtgtgtaatgaacaaggctcaaatagaacctcacgtccatttgggccatgttttggcagcaggtgaatcatgaaaatactttttcatttttgaggtatttttggattgtgggattgcagataagggattgtagatgggtgttattgttgttgttacaatataaatttctataacttctggccagttgttagaattatcccttgtttttcaatgttgactcctatccctccctacctctctccctcctcctttgatttcttctttcctgctttccttccttcctttctttctcttgtcatttctttaggatttgaagagagggcacagtatacgatctttaaggactcagattttcaagttaagcatatctgtggccaaattatctttctgctgctcattaactgtgtggccatttttctatgtaacttcaggagtttcagtttcctgagataatcatatctacctcctgtggttttgggaagatgcagtaaggtgatggatgtcaaaacatttaacacagtctttagcatataactagcacttgatagatgaccactgctagtattgctgttgtcgttaccatatcacacagcatgcaccatttgctattctcttttaagcaatgaatttattcacattcaatttcttgaacatttttgaaatgcatctggtcttcgcttacatgtatgttatttggcaacctgtctgaaaatattattaattatggtttctatcgttggctttagctttaaatgttgcttgaaggcccctggcacacagccatgcttgaccatgtgaggaacatgatgctgcccccatcaggtacagcctaatggggtggatggatggatcgatcgatagatacatagatagataatagatagacagataggcagatagacgatagataggcatatacatagatagatagataattggtagatatgcagaagaaaattagatggtagaaaggcagatagatgaaagatagatacatagataaatagataggcatatacatagatggacagataactgatagaacacagatgatagatagatagataatagataaatagtagatagatggatagtagatagataataaacagaaaacagaatagatatgagagagatgatagataactagagtgatagagagatgagagagatgatagatagatagatagatagatagatagatagatagatactcatctgatcaccaaacaggtgtgaacagaggatgttttaaagtgtgggattctgcatttgctgtgaacaggagtacaccagacaatccttctataggaggaagggaagaatgcatggggccaaggttttattttgctaagaaatcatagccttcccagagtttaattgcctccatttttatcaaatagttagaaacacgactattttttttgacccttggaggcacattggtgacatctgtgggggcagcgttactgatggttgtccgtctgtatgttgctgagccctgcaatcctggtatcccaagatgcctcccctcttccaaagaagcacttaagagctcaagttgattaccgcaggggcttgaagacgaagcctcatttgcccgattatcagaacagatgaggtgtgcacacagcctttgcaactttccattcatctcaggaactaaaatgagtaatatttttaagactaatgtcttaaatttatgattttatttgattctttattcagcaatttgaatattatggttgattacaagtacataataagagcctttctgtgattggcattttcatttttctaggtaaataaagtacctcttgatctgtttttatttttcttcctacccccactccccccatcaattttctttcacttgtgtttctctacacatactgtgggcatcccaaggggaccgtagtcttcttgttcatgtttcagacttgtaagtcgtatgcaaatgcagccatattttacagattggcaattttgctataattaagcttcatgaatatgaagattcttgtagaattcccaggacgccccatggtgaggatttgcaatgaaatttcttctcagctcactgtgacctattagagtgtcagtttggctcagtttcaacatggtgtttactcttatgaagtgcaaaccacttattagctaatttttaagccatgacagaagcagcctgagaggcacatttgtccagagggcttgacaaaaagctagaaggtcagtgtcttcacagacccactgaggttcagaaattaaatgataattttgtaaaccaggcaggaagtgacatttgtgcaattgcctttgatatgttttctttggctgtgtttggtttctttgtctctgcagaatctcagaatgagccagcctctaactaaaatggcgctgcttcatcttaaaatctctttgtgacagcttatgacaggagatcccttggaaccctggttctctgtgggacctttcctggactcctgtgtctgcaatacaaatgttaattctcagctctattaatacctcaatatcacttaaaagatatccaagggaaactttacctggccaatttctttccacaaagtagcatttctgaattggagattgctggttggctcattcttattttatttacttttgtaaacaggttatcatttataattcaaaactcaaaaagcatacagaaaaaattctagtctcactccagtcccttactctccattccctggtatgcctcccccaccctcaggtactaatagttattcatcggtatccaaccttccagaaattctcttgtatatacacaaaacaaatagaaatgtatcactttgtaccaccagtactttagaaatcatttcagcatgggtactcctgcggggtactccctgatcagattgccgcgttgtggaagatttctttctgcctgtcaattttatttccagaaaatagtggtcacattgctttagggtaagtcaccaaagggtgtagctgcgcctgtgtctgtgcagccctctggtatcctgttctcagctgaaaataaagccctggaattggtccatttcactttttctttttcttgcagtttgaaaggcacttgaactagcccactaatgttgctttttactccttttacattttaaaaggagtcgtaccctggtttatttgcttttattgcctgtgaaaatggcctgagtaattagaccaacagagaattgcatcttaagggctaattattgatatattccttgtgtcagctcaaaagtaacctctggggatagaagattaggcagagtatgcctgcccatgaatatacactgttcatgcctctctaggcttcaacacacacaaggtcatgtaaggcaaccttacctaccccattagggtccagaaagatatccacctaggagagagtgtaaatatcacacccatcaactcactcttatgcccagtggctcatcctttcaaacatgcaaaactttctataatggggaatctgaaatactttaacaagtttaaaaatctttattgagcacagattttgatttttaaaaaatatttttgatagacatactatggttcaagtcccatacttgcattaaagggttaaggtggaacaatgcttcatgcacagttagcatttcatattttttgtccagtgaagaaaagaaaacattctcaactttgatctcctttagtttaaaatgagataagataagatacactccagcatcatgctcttacttaaactgagctgattctcttgatttctatttcttgctttcctcgccattggcctgaaatgagtaggcatgacaatttttgtccatatgttgtatgtaattaaactccagcctttacattgccaccatcaaagacagcgaggaagagacattttattattgcaattcactgtcttaaggtggaagcttctgcaacggtgacacagaagcgtgatggagaaggcacaaaaatgatccatcttgctcttttaagagaggagaacataccggacttgtgcagacagaacttttttttttttttctattgaagcatcttctagtgcatttaagcttttttcttgtcaacttgaggatggagtgaagaaataacacacacagcttgtttgacagtgtggctattaatgaagcaagcaacaacagctttcactcatgcacaacagggcttggctgtgtggtttgcaaaaagcgatgaacattttcacattaggattttgaaggggctggtgaggaaactaaagatcatcagcatttgcgtgtgaaaataaaatggaaacgttaagaaaggttgaatgtagccttcaaaagggggtagaaagaacaaaatgaaataagagttgctctggtttgaatgtatgtgtccccccaaaattcatatggtggaacctaaaacccaatgtgataggactgagcagtggggccactaaggaaatgattacatcatgagcactctgcttccatggatgagatgagtgctttatttttgttttgttttgagacagtgtctcactctgtcacccaagctggagtgcagtggtgcaatcatggctcactgcaacctccacctcctgggctaagcaatcctccagcctcagcctcccaggtagctgtgactgcaggtgtgcaccaccacacctggctaatttttgtatttttcgtagagatgggatcttgctatgctgccacgctggcctggagctcctggactcaagcgatcccctcaccttggcctcccaaagtgctaggattataggcatgacctaccatgccaggtggattagtggtcttaaaaaagaggttgaatagtggctcatgcctgtaatcatagcactttggaaagtcaaagcaggaggatcacttgcatccaggagttcatgaccagtattggcaacatggcaaaatcctgtctctacaaaaattaaaaaaaaagaaaaaaattagccagacatggtggtgcacacctgtagtcctagccacttgggaggctgaggtggtaggatggcttgatcccaggaggtcaaggctgtaatgagccgtgattgtgccactgtgctccagcctgggtgacagagtgagaccctgtctcaaaaaaaaaaaaaagagagacagattgaagggagcacaatagcaccttttgcccttctcccatgtaaaggtgcagctatagggtgacattttagaagcagagaggaagccttgcctagacaccaaatctgtctgtgccttgatgttggacttcccagcctttagaactgagagaaataattttatgttatttctaaatgacctggtctcttgtgttttgttatagcagcacatgtggactaagacaagcatgatattttaggttccttaagcagggtagagaagagagtcagaatcctaatatgtctagttgctgtcaagatgggtgcatgagtgtggcacgctgtggactgtgcactgcaagaaagcaggctccattttctctctccttctctggctgcttcggaatctccctaagctagctagtgattacctagtacaaatacgcatttccagacgtatctccctgtctagactgagagtatctccacagctgagggggtatccttaacccctggtggaaaatctggtacttagtaagtgtggcaggcagagtaatggcccctaaagatgtgcgtgtcctaatttctggaaggtgaatatttcaccttacatggcaaaaaggattttgcagatgtgattaagaatctggagatgtgattaccatgaatcacctggatgggcccggtgttgttcaagggtcattataagtgaaagtcagagtcaggagagtcaagttcagcatgatgagatgtgaggaaaactccgccaggcactgctgactttgaggatggaggaagcagccatgaaccaagaaacagggatggcctctaagagctggaaaacacaaaacacactttctcctcgagccttcagaaggagcacagtcctgccaacaccttgattttagtccagtgagatccatttaggattttgatctctaaagcatgaggtaacaaatttgtgttattttgtgccaccaggtttgcagtgatttgttaccgcagctgtaaaaatttagtgcagtgaacaatcaaaatcgaacagcctcttgcttcacatgtgccatgtgctgacatcaaagaggtgctgagaaagtactgctattgattttgtactagcaccagaaagcagagagcatgcttctaggactcaacctagagctccatttctatgctcttgataaacaacttccatctgcatatttgggtccatttccctgatagccaatatgatttttaaaggaaaacaaaaatatttttaccagacagtaatatcgtattggtgattgggttaaaaagctaacagtttttcatgtatgtaatgggtgtgaggtttttctttttttcttttttctttttctttttgagatggaatctcaatctgtcacccaggctggagtgcaatagtgtggtctcggctcactgcaacctccgcctcctgggttcaagcaattctcctcccttagcctcccgagtagctgggattacaggtgcccgccacaatgcctggctagtttttatagttttagtagagatggggtttcaccatgttgcccaggctggtcttgaactcctgacctcatgatctgcctgccttggcctcccaaagtgctgggattacaggcgtgagccactgcgcctggccaggtatgagttttaatccacaaagacggcatggttagaattgaagttgtatttttgtatagttcaacttaatttgtaacatatactgcatgatgccaggtggtagaatcttaatttcatttaattcacgatgatcacagtcaacgcggggtcttctccactctgtgtctgggtgctttcctctgtgtttaggagtctaacctggggctaaaggatctcagcagaccaagtagagagggtgtggccttctttccatcactgataccaattcacggccggcatctgcagctaccaagtttccatcattgagtcagattgcctctggcctcttgtgtccttaactattaatataaagcctctccacaaaaggctctttcaacaacatctatggccttgtgagacaccctgaaaatgcctggctgtggaccaccctctccagaggtggaggaactctcttaggctgttgtaggaccatccacctgggcacatcaaagcagccatcttttttctactgctccaagaccgtgtcgttaacaggaacccatgtggaaatgttggactgtgttggagtttcctgagaccaccccttgggttgatgatttgctggagagactcacagaactctgaaaagctattgttgttaaggttatagtttatgaaacagtgaaaggatacagattaaaatcagcaaaggaaaaagtgcataggaaggagtccaggaaagaccaggcacaggcttccagttgtctttcccggagacctatagggacagggcttaactcttccagtaagaagttgtgacaacacatacagagtatcatcaaccagggagctcatacaagccttggtgtccagggttttcattaggggttagtcacatagagtgctcagatgacttaccttaacacttgagtctccaacccctcctccagaggttcaactgacacagcgtggcccagggtcccagaagaataaaaacagacactcgtcataatccaattgttggcataaacaatcttgcctggccccaagcctcaggtctgtaatgacacttttatcaggctggaaattgcaacagcttagaggttacctcctaggagtcagtcaagggcaagatctttctttagaatgtgtgggatttggaccccctaagcctgtgggattaaccctttactgcacacaggcctagattccctgggctctcagctaagcccaaagccatgtgtggtttccactgtgtctcctcccattggatgtgcctcctgtggataggtccttgactcagggcttctctgctgttagccatgggctcgttattcagtctgggtggaaaaaaatggttctggctgatcacatagcttttggcatctgttgttcatgtcatcaactaaatgacatgacacagagattaggcttttgaagctcaaagcaggattcttatagctagaagttgtttttttttttttttgttgttgttgttgttttcaaatttccaaccttaattttaacttcaggggcacatgtgcaggatgtgcaggtttgttacataggtaaacaggtaccacggtggtttgccgcacagatcattccgtgacccaggtattaagccccacatccatcagctattcttcctgatcctctccttccctccacccccacccttcaacaggccccagtgtgtgttgttcccctccatgtgtccatgtgttctcaccagctaaaagtaacttgactttctcactcctttataatcttttaccttttcccctgagaaaagaatgccaccaactaaatggggaagtatggccctagagaacagtgctgaggtcagcaggtggggccagcagagaaaaaggtgggggggctgacctcttttgtgcctgtcccttattaaggaggaaatcctttcccagaagtcaccaacagattttaaaaaatgtctttatctcattgaagttgggtcccacttagactaattcctggcagaagaaactgattttggtgtatttgacttaaagcaaacataatgtattccctaaaactgagtatatatccatcagaacaaaaccaagatatttcttgagcaatcagtcaacagtgttggctataatatgcatgtaagatataagactctgcagccttgtaaagctgcggtgaaactgagtttccaacaggtcagagagtgacgaaattgcagtagctctactccagggactccacagcactctttaggttgggaaaagcaagtgagttgcttttacaggtgtaaatcagagggatggaaattattgatgagataatcgagatgggatatgagcaggtattcagaatatatacggtttgcaaatgagaatgaagacttcccaatccttggagcagttcataaaggtatgtcaaagcctgcaggagcctaaggaagaatgtgctaacttttgaaccatgtagatggctcataagaaatataaatattgaatacacttttgctgctattagtggctgccttcatagttgtgctcagtaatttgcctgaagaccctcaagccttgcggtgttaaacattgtgattcaaaacccaaatctagccaaggccgtccatgtgttagatgcttctccaccccaggagacagggcctggagttggtctgtgtgcttggagctcatgaggcaatgacctgagctgcaaatcttcagctgtgcacccacaaagctgccccagaatcctagccatagtgtttcaggccagacctcaacttttcctcggatcatgggttatactccagattttgaactggacagctggacaacctttaggaaccctcccctagaactgggaaaactcctaaaccaagctcctgcctgacccactctccaggctccacctttcccctcttctttatttgtttatgatggagtcttgctctgtcgcccaggcttgagtgcagtggtgcgatctcagctctctgcaacctccgcctcccaggttcaaccaattcttctgcctcagcctcctgagtagctgggactaaaggcgcacaccaccacgcctggctaattttttgtattttagtagagatggggtttcatcatattggccaggctggtcttgaactactgacctcatgatccgcccgccttggcctcccaaagtgctgggattacaggcgtgagccacagtgcccagcctccccacttctttattaatgaagacagatgtcccagctcaagaaaagagagtggaaaaactcctccttcttctgcctttctgttctatccgggctctgaaagaactggacgacgccagcccacgtggctgaagacaatcttctttactcagttcactgattcaaatgttaatctcttctgaaaacactttcacagacacacccagaaataatgtttaaccagttatctgggcatctcttaacccagtcaagttgacacataaaattaacccatcacaatgtcattgatgaaaattgcctaaatacctccacccttgtgaaattgataactaccttgtctaaccacttagttaatgataagtggaaatgttgcctctacatcatgcaaaatgtgacagatagggaataaatgcttagagatgcttggatgaaataaagccttgtccagatgaagaggtttttgttttgggcatttgaccttgggaagcagttcaattaaaaaaagaaaaaaaaagtccccgtcagtgattttatagcacctggtaaaattgcaagtgattgctcacttctcccctgctccttcacccctgcaataagctttgttgtcggtcacagccttatgacctcctctgtgctgctcatctcacagagagtgtggagcaccctggaagtgagactcaaggccaccagccttctgcaatctccaggtctgtacctggagcaaactctactctgtctctctctctctccaagtttccttgcagaaggcactgctgacagaataggtgagacaaaatatagtgaaaagaggagctggtgccatccaatccagagagacaactacctggcctgcagtgccctgggcttgctggcatagctgggctcaactgaacctttcctgcacaacatctctattttgtgacctcactgtggcacactcacctctcaaagcgcttctgagacctcccctaatgtgaactaccttggcatgtttttttccacccctgcatattattgtttgtgtgtcactgttctcattgccagggcattgcattgggatttctttgtcagagcacataaagaggcgtatccagaataggtatccagccagcataaaacaatgtggcataatgtgttgctaaagtatatatattttaaattcttctgtagtagttggtaatcagaaatagtttacttgagaccacgcattatctaatgacgttggcccatggaggctgtggtggtggtgtggtcttgggagtggggctgtcttggaggtggacagaggtggaggttccaggtgggatgtgtgcaatgcctcctgctgctctggagtgggccagaggtggcagggacaacccaacagggtgggggctgaggctaaccttgaggaattggggttgggaccaagacaatggtcttttaagttcaagctagctgaaaagtgctggcttctgggtgatgcccagcccagacaccttcttttgtaaccagatgtagtgcactggcctgatgactattagcttaatgggaggtcaataaagtgtgtgaggctaaatcacagtgatgcagaatttttctcagccactttgccaacaagagacctccatggctggcgatatccccctgcctgggccttgctcagccccgggcctgccattggaggcacccccacccgctgagcttgctgtcctatagcttgtacccatgtttggcagttcccgagctcctgtcccgtgtccaagaagaatgaggatacactgacaattccaagggtgaggatgggcagagaagaattgtattgagtgatggaacagctatcagtggagaggggatacagtgggtggtcccccaacccctcagttgggttgtttatctcccagtgtggctaggtctggagctttttatggactcaaaatggagagtgtgtgctgattggtttatgagtgtgcaaaaaaggttaaaatgaagacaccactcaaaggcacgacagtgtagaaaactaattaggaaaggataggtatatgtaaaatagatgaagggtggggatcaatcagagaaaagtgcaccaaaatggaaagacaggttctcaatccagtctgtggatgtacccaggacttatagctaggctttaaactgtcttcggcttgaaggttgggtttcaatggggacccaccactgtctgcctagggatttgtctgtctcctgccactatcaacagctcagccacggacgtcagcttgggacatctgcccaaacgagagatcaccctagcaattcctaaaatcagaagtgtcaggacagttgggtaaacaatgctatagcttcagaaacttgctgagcagtgtgtgagtgtgtgtgtgtgtgtgtgtgtgtgtgtgtgtacagggatatgtatgaaattagaggaaagtttttaattactaatttatgtatttgtgcaggttgttgaattattttagtatcaccccagatatacatgcagcacagcagttattgaatcttttcagttactgagtcttttattttacttttccaaattttgcaagtatgtgaactacaactgctttctttctctatttatttgttttcttgctactcggtgcatgtgctgttgcatgcaccaagttaattcattttatttccctaacaaatgtcagtatctctccctccccctatgcagcacatcattgcccactcagcgtcactgtttggcacattcaatgtggaagacacatgggtgaatcattcccagcatctggacatttagagtcagctggatgctgttgggtgtcttatttttcatgcagatgtgaggcattatataaagcagccacatttgtattaatgttgaaaggtcctagggtttctgcattatgaaatgaaaaatagctattagctactattatctgatgaggtttgaaggtatgtagttctagaaggaatattttgaatggacataatttctcaaataatatatagtttttatcctaactacaccaaagattttgtcttataactgtgctagcactattaaatttttgtcctatcactagaaattttgctattttagacaagagaacctgactttggactatgatttatgtaatggaatttcgagtggtccattaaacttatttaataaccataaaaactggcataaaattagccataattcatcaaatcttacattatattcttagtctgggattgatgtttaatcagattttttattgtttcataacatttaatgggctatttataattattttctcaactatatctgatggaaaaatatattacagaagagtttttaatgttccagaaataaggatataaatatacaaacagtgctcacccacacaggaactaaggcaaagattgttgctgttataatttcagagcaaatcgattggcctttgtaagctatgattagtgtagacatcctaataacagcgtgtggtgaatgctggtcttctgaactttaacaactcctccaattcggccaccaataaagtgatgataataggactgaaaaacttgttctcacagtgataaatttgcatagccccatgcatatttgtggcttgaatttttcctccttcaaaatcccagagcaaaatttgaacaactttgtgtctttatgatgttataaattcttggcaagaaagtatagagtgatggcagagagcaaagcgaaactttagaagagaatattggcagaaacccttggagactggtcccgagctgtgtgtgcaagtggatgcattcatgcatgcagggcatggaggctctcagctgtgatgggacccaagagatggtccagggcccctggagggcctggaagagattggaaacaagagtcgagagtgttccctggcagctgagcaaggccagtcagcctcactgaaattcaactgcacaccagctttctacttaatatgttaattttgtgttccattttctcctgcaatcctttctgccagccactcttcgcttttacatgcttcatgttggaagtcattatttctgtcatctctaaatatttcatccaaggaagaaaagctaggatatgtctagagaacagaaactaagtttgtaggaagtttggtgggcaacacgatggactccagatcagtcaatgccacgtgagttctctttgctaacaagaaatcagtgctcatggtatcaggtgaacagccccccttttttttttttttttttgacagagtctctcactctgttgcccaggctggagtgcaatggcaagctctcagctcactgcaacctccacctcctggggtcaagcctcctgcctcagcctcccaagtagttgagactacaggtgcatgccaccacacccagctaatttttgtatttttagtaaagacagggtttcaccatgttggccaggatggtctcgatctcttgatctcatgatccacctgccttggcctcccaaagtgctaggattgcagccaggagccacttcttttagtgattttcaggattaatttctaggccttatgttccaccctgtgtctttcttttcaatcctagtttcacagcctgctcccttcatcggctcaaacttcatggtggtactttatctcctccaccgcctccaagaacggtatcttttcatttagtgcagttaattttataggctaaaggctctaaggttctaatacttgtattgtttttcactctgcacccattgtattttatagaggaaatatttttgatgtcccaagacagtttaaataatttattgttttggaatattccctggacacaacaaaatactttttgctcaatttttccatttttctaaattgaaatgaatttagaagtgaatatggtaaaataattgtataataaccacttgattttttagacccatgacctaatatcatcaaaacacatcacagtgttttgtgaattacaggagtatttacctcagatagagaattggattgtgcatttctaacataaaacatgaagaggggcaccgtgtatgcctgcctgattgctatgagatttaggaatcgtcctacctattcttctcatactacttatagttataagtctttactaaatagtggatgcctactaaaaaaaaaactgaattaaagcatcacatgattccacaaatatggatcagttccaattttcactattttaccctaattcaattaacagccttctacagtccagctgaatttcatctttatgtatcatcatctctaataaaacatttttactcttggttcatgatttatactgctctttatcggatactttacattcagttattgcatctctgtggtttcggatgcctgtgtagcatactcaatcatcaaaactgtaagaaacagggctgattgttatttctatgctcaagaacattttctttaattgctgtggctttcaggacatcaaacaaccaccacagaaggaagggaaaggaaatattagggagaaaggatgcaagaagagagtacgttaattattctcaaaagagcccatcatgctctttctaggctgtgctaggaaagtgtcctagattggcagcccccggtatgtgtatgcttctgtggccaaaacctgaagctggaataaaatgaagtgtttttttcttgaatctttacttgcaaaatttggtagaagggtatgagtgcttggctttagtaacttgaaaacaatttttaaaatttggcagttgtattttgaaactgttttaaaaagaagaatgactatatatctcctcagattttagggatggaacgttttgactgtgagttgtccaggttcttggtgcattgagcaaagaactaaacaaaatccacaaaaaatgcaacaaggaatgaagcaatgaacgaagtaacaaaagtccagctttactgaagtgaaagtacactctacagagtgggagcaggctcaagcaagcagctcaagagccccgaatgcaatgttctttagggtttctattaagctaaaagaatttggtaacacccctaggtgccctttcgaggcctccagttagtcacaccctatgaaagattggcccaccaccaatcagaggctgaagtgaagacttggcccacagtggaccagaggctgaggtggaaactactgttttgccatcacaggagtgagggcatggcctgtgtgctaatctttcctagaactggccgaacctgctgttttcttgcttatgccttaacccttggttaccctaaaccctattctcctgcctcaccattggttagctatccattttctattttcactcactctgatgagggtcccaactacagataaaccacttgactcaccaaacactgcttgctgaagtgagaaatgtcataaagttatctgagtttggctttgtactcttttatttgaaagagcgtgttcatccattaacccatccattcagaaagcatttattaagcacctgctgtgtgctggctttgctcactctgccaagctgtgaaatctgtttctctaggcggagttctgaagtcacccacattctgaatctcagtcttggaccaactgaattagaatgtctgggctggggcttgggaagttgggagtttaacaagatctgccatggtttttatgcatggtgagcctgctggtctcaattgaacaaatgtggatggaatgaagcatggattagtctgttcaggctgccgtaacaaaatccacagactgggtaacaaaaacaacataaatgtattttcacacattctggaggctggaagtccaagactaagtgttggcaagtttggcctctccttggcttgcaggtagctgcatactcattgtgtgctcacatggtgtttcctctgtgcacacatccctggtatctctgtgtgtggccaaccttcttatgaggacaccagtcattggattagggctcactttaacagcctcattctaacttgaagactctgtctacaaatctgattctactgggactgagggcttcaatatatgaattttgttggtgagacaccattcagccaacagcaaagcaaaagagtccactcttggccggcatcccaaattagttgaacctctgccatctcaagccagagctttgcagtccactctgaaattggtgggtgacctgtggaggtagtttctcccctgagagcttctcagtgcacagttaaggctctgaagtcctcctgagcagctcgcgaaactgaatttaaaccaaagttttctacaataatttcaccatgaccctctgatgtttgcaaaatttctgttctcaaacaggttgctcacttgtaaaatatgttgtttctccaagctagagaaaataaaacaagaagaagtcaggccccttcctgaaggccacccaaatgtgacttagagatgagatatcaatctgtcttactcagttcaagacagtaggaaaaacattgtgtatttacaggcagtagccatcagacagatcttattcctacatatctgagctgcactctggaattttatcatattaatctctagtgtctcttcatctacccaccccgccactcatccctctaatagaaaacagttttagttcactccagagactgcagcaggtgccaggagcctgaaacacacagcagccccagcctatgtatcccagagccctgagtccaggctctatgctcttatcaaagcaaatacagagcccatcactgggtctcctgggaggccctctgccctggtgattctcattctcatcacacatcagaatcacaggaggctgtaatctttgagaggccaaggtgagccaattgcttgaactcaggagttcaagaccagcctgggcaacatggcagaacccccaactctactaaaaaaataaaataaaaattagctgggcatggtggcaagcacctgtggtcccagctactttgggtggctagggtgggaggatggcttgagcctgggaggtgaaggttgcagtgagttgaaatcacaccactgcactcaagcctggatgaaagagcaagaccttgtctcaaaatcatttttaaaaaaatgaaaatagaattacaggagagcttgtgaagaggcagatccctggacttcattcctcacctctggaaccaaaaactcctgtaactgggggcagaaaaatttctctttttggaagctctccaggtgattctagttctaaaccatggctctttccggtgtaatttctcagtactcctaatgggtgcttttaactatgacctagatcagctgctccctcttgcttgtgctggatacatacttatcgtgcctctgttccagccatgtcaccctgctgtgctctccgcctccagtgtttcttcattctttagactagcacctgcccctcttcaccagggaagcctgcatcatgaggaacaccagtattgaagtcttcatctctgtgttccttcagggctgtggagtccaacagccagggcccagctgtgccagtacaagatgtatcaccctggacaaatatttaccctctctgagccttgattttcccatcccaatccacaacaggaatacatgaatataatctttgtttttttttttttttttgagacagagtctctgtcacccaggcagagtgcaatggcgcaatctcagctcactggaacctctgcctcccgggttcaaacaattctcctgcctcggtctaccgagtagctgggattacaggcactggccaccatgcccagctaatttttgtatttttagtagagacggggtttcaccatgttggccagggtggtctcgaactcctgacctcgtgatccacccgcctcggcctccccgtagtgctgggattacaggcatgatgagtgtaaactttgaaatacatattaacttggcttttatcagtgtgtagtaaggctctccatgtcagagtaaataaatccaccaaataggagtcaaataaattcttatctgaaaatccaagccttaagattaggatattctagaacttctcttctagatattttcaatcatgttgaatctcttgtgttacatatttaagagaaggagaaaagaaagcttcttttgaaagcctgtgaccaaaagaaagaactggaaccagcaaaagcaaattggtttgttttcactcaaataaccgtctgcttgacttaaatgtgatctggcaaatgggcattgctacaggaaacaaaaggcttcttttgagcttctagagaaagagaaagcatcctgaatacttaatcaagataccttttcctacaattagtggaaaccagctcatgtctgttttctctcgccccgtttccttgtataacactcatctagctgcttccgtgaggtagatttaaacgtccaccacccagaccacacccatggggccaccaacattctagagcagcttgctctgtgcatcttatccacactgccatgcgctctgtttatctcattagaaaaacccttgcatatttactaaaggcaagaggcaaaataaacgctgagttacatatgtaaaattccatgcagcatcgttctcctatgtattactaggtttggttattttacatgaagacagtttctttttacacaaacagtagggctcttatgcagttgttctctttcaacatgaacacaatagactagataatgttgtctgtttatatttctttccgaaagtaggaataatttcctaaattgctttcacgtactgtgtaaaacaccgtagaagttctgaggcttatctgacatctcattgtcccctggtgtgtgtgtgcgtgtggtgtttttgtgtgtgtggggtgtgagtgtggcagagaggaaaggggagctgtttgattctgtagttccttttctgccttcttcctttctctgtaaactttggatacttatccaaattactaacggcagattgagccctatgcagatggcatgtgtctgtgacaacctctgctctccacatctcttgggcctgtttacctgcgctcccagagcctccgccagcatcccagaatctccatccccatctctcacttatacacacatcagtcatcggttatccattagctaaaccgccttccttaatagctttacactgtttgctttctctggaacatttttagttaaaatttcataatgcagttgcacacaaatgaagacacagatggctgcatcctccgtctcttcccctcgtttacaggaagctgcggatcagggaggggtgttagggttacccacatggtaagggcagagacaagaggggaccccagttttccatgctgcacatggtcattgctggggactgaggtttgcacatcaccctgccctgttctccctccgctggggagaaagtcagggatggagcaagctgcagcatcttctgaaaaagaaaaggtggccttgtctccaggtctcccctcaagtcccaccttcccatagttttctgccacttctcttgattttcctctctgccacttctcttgattttcctctctgcagctgctttgaggtgggttttctccagatgcacactttcccctgctttgcgtccttattctggtagaagcacaatctaaagctcattaagggaactaatcaattctgtgcatggcgctagctcagcagatcaccacacaggcagcactattagcaagtcggtgcttaacacatggcacttccatgaatcgatatggagcccgtgtagaacaaggcatgggtttttttctcctcccattaagaaaaactgatgccaaaaataacttctcagatattttcaagtatgacttttatggagggaaaaagcatttttgtttgcaaaatcatgcttcaatgcaggccagttgtgaattgtgatggcttttatttctcctggggctgtaactttaagggtttagaatttggaaccacagcctagctaatcatgacacacacacacacacacacatgcacacacatacacatacacaaagcatcacgaagaaccatacaaattgtacattattttacacatggaggctcactctaaaatagataccattttaaatattaactaaaacttgtgctcattgtatgttcattctatatgtactgatttgttattcacatttctttcaaaatcgttcaaatttctagcccacatcaattaaatattaatagtactttctacaaacatgagcgcacaaaataaattcaaatctatttttcccactggtgttatcagtactgctcatactttgtcagtatctaagtatcacatgatcttaaaactaatgtcacatactaaaaagcttctgaggcaaattgtagaaagaactctcaacatcattgttctactggacaacatacataaaattattttacagtgatgggagagaaataggctcctcatcctaaaagctgcgaagacagtagcggtgccgtgttttggcgttactcccctgtggatcccagcgacgggtggatttctcctgtgctttatcatcagacacaaaatggaccaaaatggaccaaaatggacgagtgtgagggacacagaggctgctgtaaaaaaaaaaaaaatgcaggatatttatgggtctatgacgacccaaataatgagcaaacatgggaatcccctgctgaaaagctgtcacagaactgaagcctgcctggaaatatcttgagaatgttgatatcattttaataggatctaaaatgagaattctatcaatataaaacagggagaagggcctccttctatttttaaaaatacccaacattcatgtttttcatattttcctagcctataattactcttaatcaaagcacaacaaatagtaaacagtaaaaatgaaataaatgtggtgacagtttgccaataacgaggagaaaatgtcccatctgtctagccgcgagtaaaatgggtgtaattaccgctcatttttctcgtaattgctgagttattagtttaaagcttacacacaactggtgaacagtgagtactacccattccgtaattacagccccagcctcgccgtgcttgaaatcagggaatgcaagagcagaggaaacgatctgaattaaccctgactgcttgcacagaattgtgactgtctatcttatatttaaattttataaactctgagttcctttgctatccaaatgttaaactggaatgtttgcaaatccagcttgaattctaatttgcttttaagctatagtcttgcatctgcttctaatggtgaatgcataaattcatttttgatagaaataatccatgcagaccaccaccctttgcattgcatttgttaaagttatgcatggttcactgatatgcaggggtctgttagcagttatgttaccatctcgttaccagggaaattccatttgaaagtttaggattacacatgggtagtcaacacctgacgtacacagcagggcaaatacagaaaaaagaatctcccttgattgtttctgtttattacaaatcaaagattaagacaaatagagctgtggtttatttcttcttccagtatgttattttatctctgagattcacctaagaaagactaagttctatgatgttctcatagaactatagctacttttgcctaaaatgctgatatcattttaataggatctaaaatgagaattctatcaatataaaatgggggccgggcatggtggctcatgcctgtaatcccagcactttgggaggtcgaggtgggtggatcacctgaggtcaggagttcaagacctgcctgaccaatatggtgaaaccccatctctacggggttttttgtaaaactacaaaaattagccaggcgtggtggtgcgcacctgtagtcccagctacttgagaggctgagacaggagaattgcttgaacctgggagacaaaggttgcagtgagccaacatcatgccattgcactccagcctggctgacagagtgagactctgtctccaaaacagaaaaagaaaaaaatttatatatatatatatagatatatatttatatatatttatatatgtatatatttatatatatttatatatatatttatatatgtatatatttatatatatttatatatgtatatatttatatatatgtatatatgtatatatttatatatatttatatatttatatatatttatatatttttatatatttatatatatttatatatatttgtatatatttatatatatatttatatttatatatttatatatatatttatatttatatatatttatatatatatttatatttatatatatttatatatatatttatatttatatatatttttatatatatttatatttatatatatttatatatatatttatatttatatatatttatatatatatatttatatttatatatatttatatatatatttatatttatatatatatatttatatttatatatatttatatatatatttatatttatatatatttatatatatatttatatttatatatatttatatatatatttatatatttatatatatatatatatatatgaatgagaagggcctccttctatttttgaaaaatacccaacctttatgtttttcatattttcacattctagcaaaggtagattttctgggttacctctctttggggtcctgtctttggtctatacagggaactgtaactcaccacagacagagatagtgctgagatgacaaagctgggcttgattccgcttggatccctggcttctcagccattcctgatgaaccttttattagctgcctgtctctgatccgggaacactgatgacaggtgcgtttattttgagggagcatatcctcaagctatggagtggttgttgaatgagatgttgtgaaaaaaaaaaaaaaaaagtcatgagacccccggccaaaatcctcagactagcgtggcattttttttttcctagcaagttatgtcatttaatttatagatatagaagtggagacaatgaaaatatagcatagtatgttcatttccttcctctgagcctgagtgatgccaaggcatatttttctatgttagagggactaccctggaaaaaggaatggttatagtaaaatttggtatggaagattcactgatacgaatctcacattttcggaaagagaggagatgaggaaaggacttggtgatgatcaaatataacctaagaatcaaagttatttccattcctggctgcagaagcagtgaaccacccccttccttcttccctctctttctttctctctctctccctctctctctaatatttaacctcttggttgagataagctggtgaaaatcatggaaatgtatttttaaaatcttcattctaagcccccgagaaccacagtatgccagattcctttgagctccgcataaatgtcttggctccgtgaaccacgtgcatcttatgcataatcctttggttgtgcgcgccagctgggcagcagagatagcgagtgctggggtcttgcagctttaaaactgtgcccaggcctcactcagaagtaggaaaatgaaatgagcatttgcataatctatctcgagttacccaggtttctttcaatcttcttatcacgtttttaaaaaaatctattaagagaatattagaacaaaatgcatttttctcttcagagaattcattttgcctgcgtgtttgggtcctatagggcttttcatttgttttagttttttaaaatgccttaagaaaaatttttaggagtttactttgttcctactcttctctatttgagtcagcaacacatatttagattaattcttttgacttggaagtgcagttctgagcgattacaaaatttttatctaaaaaggctctaaatgaattgaagttgtgaaaattgtgataatttatttcctggaattgaaatacagagagaaactaaaatacacaccacattttaattcagtgttaatttctcccatttgcttataaaagaaaacatggtgcagatcttgtgtacttgaaataactgtccacacattctcaatccacagtcacgaatcagacacacacacatgcacacacatgcacacacacctgcccacgcacacaccggcatacactgctaaagtaacaagcttgctctccaggcctgtgctgccaaggctggctggccagactgcctgcctccctctctctttctttcttaactagattattttcattaactctactttctaaatctttctttacctcggtagcaatttgcagctgcatcatttactgacacgtgtttcttgaagttccctagcaggcactgagttttgaaatccagcggtctccagtgtctggcccgcacaccagcatttggtactgctgccctgtccttttccctcctgctgacatccctccctccaggctgtctgctgtgtgtcttcgctttctcttctttattttcccctttctctcctgtcgatgggatttcccttctttcttctgccttgtctgtcccctctctgtgtcccttcttccttgaatggtgacctacctctctacaggctgttcccagatgccgtcattctttcatttaacacagaagtactaagaactcatctgtacctggtgctattccaggggctggaagactacagaaaattttagagagacaaaattcctatctttgtgaaacttatattccagtgggagcaggcagacaactactaaaataaacatgtaacatgctatgtttgatgaaaagtgttgtagagaaaaataactcaaggaagggtgatagtaggttgaggctgtttaatgctttaaacaggatggttggtgaaggtttctgagaggtggacgtgggtgcaaagacaccctttcttctcgctcagttattaccaaaacggaaaaatcaccacgtgcctgtgctgaagacaaccttgtagatacacaggcttcaaatgaatacactgaagttcacacatttctttaacctgggatgtcccaaatatttctttttagatttgtacatattttgttttactgatagcttatttgatgtattaagatactattacagagaacaggaatttctagggcatattgggaatgaaaagtatggccatcgtgttgcatctgagctgtgggtccccatagaaatgtgaagagatgagggaaaaggataaatctttggaggaagagtgttgtaggcaaacagaaccgtaagtgcacaagtgggagtgtagtaccactgcatgctggtagaagccttggtagtgaagagctgagtggggaaacacggttccgtcacaaagtccctctgtgtgcagacagaggctgatgccagctctatgcctactgccaaccgctgccaccaaaaattacggacagaacaagaggaacaaaagccacagagctggtctgaatctcattcctgaaacatctttcctcttattgttttcaaactttctgtgttttgaaagttcttaaatgtaactcttgtgcttttactcctccattaaccgttcatcaagtcgtctttcaataaagagacttatatgttgtgtctttgagattcctttatattgggatataaaggagcatatcccactaaggaataaatagctgctaggctttctctttctttctatttgttaggctatgttcctgggtcgagaataagaaatagtaaaccctttgtgtcctccctttgggagaagaccaccttatacagcaacaacatgggatctctggggcgcatcattccctgggaggcttcccaatctaataggagactgcctccctttgggaaaagacaaccttgtgttttctgtgtatggttcattccaagttacacacatccaagcatcttacaccattgaacacgctctcaaaattcactccaggcatttgcgttttgactccatgcatccccatcaaacagttcttagcctacagtcctgacggaggcccatctgagcagccatcttattctcaatgtctagctaacccctcctttcttctcactcagttattgccaaaatagaaaaatcgccatgtgcacgtactgtacgtggctgtggatacacaggcttcaaatgaatacattgaagttaacacattctttaatgtgggatgtcccaaatatttctttttaaatttgtacatattttgttttactaatagtttatttgatttattaagatgctatttactgagaacagcaatttctaggacatattgggaacgaagagtatagccatcttgttttatctgagctgtgggtccctgctcttgcagagagatgtggaactgggtcttgctgtgagatcttgtgaagtcaccgccttcctctcaggaccaccgccatttgattatacgttgtgtgcattccttcacgtgaccatgtgccagatgcaatagaaaaagtcgtttcagactgccactctctgcttccaaaacccaagtatcacattggttggaatcgatgaaagtaactgtcacccagcatttgtgttcgctggtgatgatgtattaaatagggaagaaccacaggctgggaggacatcagtaaacaacctaaagggggttttaaatagcaaatcaatatggaacaacggatgtagaaaattaccaggaaatggataattaagttcctgccatgctcttttacaaaatctctgagaataaattctcttaggacaaataaagaggaaaagtgatgcccatgaaaaccttaaggaaatgattgagtgttggtgcttaaagtgatggagtatcggtggtgtcatagtgtgcaaagggaacccacagcctcttgaagggattcgcacatggtcacgtccatctttccattccagtggcgctgggcttcctgtggatgcagcacagttaagtgtagtggtctttctaaaagcaccgcacaggtgcttgtcaatcaacgtggaatgaaagccaccggcctagggatgaagagtgagtgagacctcttgcattttccgactaagcaatttcagtgctgtcgtgtgatcttgttattccaataagcaaaacacgttattttattttgggctcagtgttggatatactgaaaacaatgataataaccagcatttactatggagcacatactgtgtcccaggaactgtcgtgtcctttatatgttttacctcgttactgagtgtgtgtgtaaaacagctctttattatgtgagcagaacaactccccaatatatgtgtgatagtagtgtgtcttttaatacatttgtgtatgcatatgtatatataaaacaactgtcctctcaccctccccccacccaatttccttttattcttgtaaacgactttctctacctcttcatttttttatttacagaatgacaagtattcataaagccaggtataggcagattctatcagttggctacaatagctggatttgtcttgggggtagttttatttattattttgccctcctatttctgacaggctcatgaacccctgagcactggggtcagcatagacctggtcagcagccttggaagccagcatagctctttggaggccccatgcccagggcactacccttgcaaactcagagctgtaaaaggatgccctcttcaactgcgtggacgcgtgctgttcaaatgcaccttctcacagaacctgtgcagtagcgcagggaggcagactttgtcagaattgtacccacattttactaggaaagcaccaacatgcagacagtctgaagaacttgcccatggtggcgaggatagtgtcaaagccatggcctctgttgccatcaccctttatttttccttctgcaccacaagcccatgtctcctgatatgactgggaagcctcatggggagtgaggttccccacagagatcagatgtgttgctgtataacttcctactttgggacagagataaaatggatgacttctttggccctcccagtcctgagattctatcatccagattcattccagtaaacatggaacaccacctaaatgtgctggagtgaacagagtgattgtttccatgactgatttcagtgtcttaattccttctcaccaattccatgactgtggggcctgagggacaggacaaaagagtagacccaatactgggaagtcttattgggttgcaggggtgctctgagtcagctggaggaaaacggtgaatcacccatgcaagcccagaatcccacccaaaaccatgcccagaattcagacacattttattttaaagaaataacaaaagtggttgaatgaggcaagatgtgggagtgaaagactggacctgatggtgacagctagggaaaggaatctgagctgctagagcagttcagtagctggctcaattatcaagcggtgagatttgctggcaagagtcaaataaggaacaagaagacaaatgacatggggcagatagagctgcactgtggcagagctgatctgcaggctggtggagcagaggaggggagccactgagccatgcagagaggccacgtataagataatacgaagtgacttggccaaaatgtgtaagcacagaaggttcattgctggcatacacaatttctgctacataacatggtgtccttaatggccataactgctgaaaagcacagggagaaagtggatgttatctaatttataaaatgataatacttttattatccagattgatgacagatgctccaacccccagagtctttctctccttggccccttgacctgaattcttcaagcggggacttcgtttcatagcctctgagcccattctttcttcccccaactccctcaaaaatcaaattacattgtaatgatctgtccacctttgggtgacactctaccgtgttcatctgagactctctccagcgtttttgtttgtgtccaggcttccaggaaagctgatggggtctacatgcacttttcctatatcccccactgacaagtacagtgaaggccgaatgctcagtgaacagtaactttctgccctaaatccaggtgggtgatggatcaacactgaacttttatttatttatttttttagaatatattactttggctgggcgcagtggctcacgcctgtaatcccagcacactgggaggccgaggagggagaatcacttgaggtcaggagttcaagaccagcctggccaacatggtgaaaccctgtctttactaaaaatacaaaaactagctgggcatggtcacgtgcacctgtaatcccagctactcagaaggctgaggcacgagaatctcttgaaccctggagacagagatttttgttgtggtaaaatatacataacataaaatccacaatttgagccatttttaagtgttgactatacaccatttaaagcaacaaaaatgtttgcaaattcgggttttatccaacaatgcatgcatttcctgtagattttattctcacctcacctctgtatgaactctctgcctctgcttctgtcaaatgtgtccgttccctaatattagacatactttgtgctttcctgcttaattaattgtttatacagcccttctctttccttttcacttctgctttcctggccaccacacctcttcctgttgggctccatggtagacatccatcagcatttactccttgcctcccagggaatctaggtcataaagggcaccctctttgtttatagcacttaatagtaattgtaacatctctatgttgtctatattgtcatttacctcttctattaactattcacatgctaccagataacttcttttattaatctgtatgtatatgtcaggttctatagtagatgccaggtctccaatagtaaatatgaatatgattattaatattaaatatgatttgtctccttttctcatggaagttttatactctggacaaagggcagacattgaacaatcactgtatcaatcagaataggctatgttgtggtaggctaacaaccttcagcaccttcgaacaacaaaggctgattaatttcttgcttactccatttgccctggtggctcagctgtgactttcatggtccttactcatggaccttccacactgagggagcatgctgcatctggggaattttggatatcaggagcactgagaaaaagagaacacagtaagtctcaaactagctcttaaaactccttcctcacttctcctcttgtttcattggcaaaaacaagtgacacggccagttctggcttcaatggttgatagatatgtaatcttcccctgaggagtttgggtatcgtttaactggatatacaggctatacatacaaatgcacaattgcacatttttatgagactcaaaacccttccaaagtaaatttgattacttctgtttgaatttggttttgaattttctagaattaaagggttcgaagaaatgtataaggataatcttgtccaatcccaaatggtttgacccatgactctcaatctctgggcctctgcataagagtagagactaaattattttataggacaagaagtagagtaaacatcctaagtgcttgccatagagtaagtaatatcacacacacacacacacacacacacacacacacacacacacaccacacacacacatactacacacacatacacacacaaaaagatagatatatagggctgggtgcagtggccagggaggccgaggccggcagattgcttgaggccaggagtttgataccaacctgggcaacatgtcaaaccccatctctccaaaaaaattacaaaaattagctacatggtggtgcatgcctgtagttgcagctactcagtaggctgagttgagaggataacttgaccccaggaggcggaggttgcagtgagctgagatcgcaccactgcactctagcctgggtgacagatcaagaccctgtctcaaaaaacacaagaaaagatagatagatagatagatagatagatagatagatagatagatagatagatagatagcaagtgcttataccatggaccattctaaatgtttttcatctattaactcaagagtcaacaaactttttctgtagagtaacagacactagatattttaggttttgtgggccatgagatctaggttattactacataactctgccactgcagtgcaaaagtggccacagacaatacataaacaaatgatcttggctgtgttccaatacggatttatttacaaaaacaaacagtgagctggtttgacctctgttttaacttagtttattctgatgacaaccctactgttatccccattttatagaagaagaggcctgtagaggtacagtaatttgtagaagtgcagttgaggcttgtagaggttcaatcatttgtcaaagttctctcatctggtaagtgggggagccaggctttcacaaaggcaagttggctccagggttcatgatcccaactgttaggattcatttcttctctaataatgctactctgctgaattcagttaagctatcgaagtatggatcagaaaagagggttgggcttccaatatatttgctcattttatggatgatcttttctgtctacaaagacaaaagacacaaattatttgtggtttcattgtgctggggttgtgtgatttactgagccacactaaatacacaacaaggtggtatacaaagtggtcaaatgtaccatctgaatcattcttgacatacacggacacacaactttgggggtcttcaagtttccttctacccttcccagcagggtagaagagaagacaaaaacacagcagaaaaactctgtccaagaatgggaaagagtagttatggcatgcttaggtggtgggaaacagctgatttaaagttagtaaatctgaatccaaataatggttcgatttctctgtgcaaccatgcttaaatccccgtgcttctccaaatcggagctttcacgtctgaatcatggagatagtatatctactaacagatgtgctgtgaatgataaaggagtttaagtaagtgcaagtgttggctaaattacagcatcttatagatatatgtaaagtcatcgctattactggattgtccttagaaataagggttttgcttttgttgtatttcaaggtgacttaagtatggttgactgcatatagaaaaggaagaatccaaacatgtactcgctgtaattgagtctttaaattgcatatttaaagaaaattactagcttttaaaatcccaagtgattttagagaagactcacagaattgttaaggctttccacaacatatttactcatatagtgggggtggaaggagttggatttgcccttgtggttttcatagagttgacagcttttcttgcctattccacaagttctaatgctacataatttttaagatttggtccactcagctatcactgtgatctcccaacttaaatctgttatcaatttttcagtcctctcctagttctttgcattcacttctatttgccacaggttattagagttatttgtccattcattcaactaacgtgtggctgtctattatggagaggcagtgtactagatgttagggacacaaagctcatgaagtagatatggcttctgtcctcagtcggtgtatctctcagtcagaatctgttacttgagggggcagctggagctctttctcccttcctagtaggctgagcatatggaaaccagattcccagttaattttagttgttgttttcttgatacgtaaagaaaagatccataaactcaagatgctttcttatgaatcaagttttcaagttttatagcattcgctttgtactacttgttttgaccccattgagaagttttatttcttctgttctcctgattcttcgccattttagcagcaaatatgtacttaccatccactatgtgattgatgctttggaaatacaatggaaaacttggtagcaatgaaccctctgcctttaagaagcttatattctattttagattagggaagcaggaaggtctctctatgtacaatagaatgggaaagaacgagccacataagtggtgtcaaagaggaatgcaaaaagacagcatggctggagccaagtgaaactaaaaagaagatgaggttgactagagacatgattcagatcaccagaggctgggaggcaatggagagcattttgatttgattctaagttcaatggaaagtcaccaaagagttctaagaaggagtataacatagggtttgacacagtgggtgggtgaagaagatcacacttgctactagagatggggagtacgttgtagaggggaaagtatgggtgcagagagatcagatgggggttatttcaggtgtctacataagggatgatggtgacctcaaatggaagtagaggtaagtggagagatgtgagatacattttcagatagcaggagtaggacctgctgatgggtgtgttgacatgggctgagggcagggatgaggcaggaagatggtaaaatcaagaatattcctgggttgcgcaacactcctctgtccactccctgtgatgcgatttggcatttcccaactctgccttccctcctaaaaatcaggaatcggtcttatattaattttattttgggttctgtatctgttgaattccataaacatctctcatttttttctggttactcattcatctatcagaaattgtgtaaagtccatattttttcaaatttagacacctaaataataaagatttaaactattaataaacatgtacttaatttcaaaaagagcctgctagacataggtgaatagggtttcccatttcccgagaggaggaagaggtgaggaagattgtgtggggaaaattgagaggaaaatggagcagtagtaaaggagaatgccagctaaagggaattttgttttgttgttgttatttgtttatgtgttttttgtaaagatgagatacagtagagcatgtttgcccagtgagtacagtgatccaatagagaataagctgtcgtggtgcagatacaagaaagataaaagaacagacgtaatgacatccttgagaaggccacagggtgggggctttccagctcctgcagcaggatccgccttgagtgggtgattggggtgggtgcagggtagagagagattctaactgagcaagtttaggatgagggcttgcactccagaaaaggctggagaaggcactgagagagctgttaggagggaagccagagatgagaaacatagaatctcatctcagggagtgaaaaaggagactcctagacacaggatggtgggcctttgttgagcgactcttccatagaggaaagtgccggatagctggtttctggagaatttaagtattactgtattatacattataatgcatctttgtataatgtttttctcttattccccaagatctttcattttcttttggaaaatgtggacagttagtctccatgtatatctctgtggtttcttactcttatattaattttgttttgagttgaatatcaattgaacttcatcaacatctctcattttttcaggttactcattcctgtttcagaaattgttcataaatgttcattattttcacatttggacacctaaataataatgatttaaactaaacatttatttaacttcaaaatgtatatactatttgccttttttatggtgagaatatatttgtataatacctatttatgtcaacacagcaactaacataataaatatactcttagattataaaagctcactttatataatcaaagaattttctttatgttataaaataactggtatgaatatgctatttagattatcattcaattacttacacctcatttctttcaaaatgtattggagatatttcccaatttgcaggtgcttggaaggttggagtgatgagtgtgtgtttgtgtggatgtgcttttggatgtgtatgcacacaaaggtttcttctttcctaatctaatatttcttttttcttttttggcctgacttctatacacaattttcttagcccttctggtaggttatttaggaactcaaaagtgctgggtattggctttcatgtcctgccagccttccttcttttctttgggagaatgttctgcattccaggagaccctgctcccaagcatcattcacatggtcaggctgtccaggtgcctctcaccccacttggagatgaggctgctctgttttcctactttggtaatccctgcctctgttctaagggcctggccaaaacatggaaagtcttactcttttttcaatccgatcttacagcagtgctggtgacattttattctaggtagatgtttgcatgaggcagttcttaaaaaaaagtttaaaaaaagatctttctgtctctgagcttttttcatctatttcctccttctgtcatatttccagaaggtaattgagagtcagttatgttttattttattttaacccagtgatacaggcaatgatgagtttgcatgttagtaaaatgggaaaatgagatgtgtagaggctgaggggcaaaatgagaatcggcacaaaaatctgattgatacaacattctgtgagaggcaagaatgtccctgttaggcaggaagccctgggtaagataacctggaatgggtgtatatgatcagaacacagggcaaaaaaaaccatcctcaagacttatcgccatatgaagactgaaagacaaaccaaccttctgagtgaactcactgaaaaaaatcttgtgtgcctggaaacattctgaaaggggcccctcccttgggctataaaatcaatggtgaatatcattatcaaatcagatatgggtaagcttttacagcatccagttcccagtgactatcccttaaagaacaaaacaaaacaaaaacaccactatccgtaggcaagtgttttctcttgaccacatatttacatatgaaagtctattctggggaaggacagtgaggaagatggaaaaatcaatgaaaagctccctctttgaatttgtagaggcctttctttcaaaggtgagcccttctgcacagatttgtttgcagagacccacacaggccccatatttatttagttcctatttgaaaagaagctttcctcctgccttagaagaagctcattacagatagacttcacctttctgttgcaaaagatgtttccttgaaatgaaaatgtaatgagtgttagatcagtagcatgtagctgccaggctatctctttgatccagtttggaatgcatttgttaaaaagctgctttattgatttttttagctgctttttgctgtgtttggatcatttgtacatatacacatcacaatttttgctacatcaaagtgcttaataagttcactgcactcaggaaatagcatacaaaacaaaggaactttgctctataaagatttctgcctcttaacctccagtatgaaagttgtttttaatgtgtttttttttttctgaatagcttcaaaatattttatgcagtcttcaatgagtcagccagggccccgcttcagatctccttctttgaaaatgatgcattctggaaaaggaaggatttgattgaacgagtaaacacatctcacatccattctgctggacaggagtcattttacttcaattaattatttaattggctcaatttgtgggtagcggcagcttccaggaaagtgttgacaatatttgatgtatgtgaggatagctactaatttagtaataagttgaaatttactaggtaactaatgtgatgtttgtttattaggtccaattatatgacaaagaatgagcacattataacctttaatgctgattttttttttttttgtatcatgtacatacaaatcagtgttaagtgcttttaactctaaacaggtatttcctgggggcagactcggagccagctcagtggaaagcacgactgggaagacagagctgagtttgctccacttttggtctcaggccaaaagtgctgactgtggtcaagtgtgggctgcacagaggagctgtccaatccagctttccaactagacccctcgtgctggtattcgggcaggctatacctcctgcagatgtacaaatgaacatgcattaaagattttatttacctcattcagtgagggagctaggaaaacattataaacagttgaaatggggatcaaaaccaacatttatttgtcagtaatagtgaaatgaatatgcaaatggagtcaaaactggtttttccatgggaatggtgtcggtggggagggaaaccaattaaacccctatgacaggtggaatttatggtgttcattagttacctacagactataggtttgtaaaatagctcaaagacaatgaaaacttagaatgtgataacctctagagtctagaaattgtggcgcttcccattgaagcacacctttttttgtacacctccaacagtggggcggacactcaaatccttttctttttgtctttaaagtcaggaaagtacgttgacttcaggggtcaggtgaaggtcaaggggtaagaaaataggaggcaggtgataattgtgggcttccagtaatattctggtaagtgaaaaggaaacatgacctaaaatagcaatgcatcaactgagtatttaaaagtcttttgtcttttctagaaattttgtcatcgtggtggtagttgatgtaaaaagtggttttcctactttgaattttatcttttattctctctctctcttttttcccctccctcctttctttccttccttcctttcttttttcttccttcctttccttcccctcccccctccctccctcccttctctctctctctttctttctttcttttccatgacctcattcagtgccagttcacattttcatcttgatccatccctttgtacattggactctcaaaaacagcaattcttaacagctcaattggatttgccatttggggccatctctgtacatggcctctaaataaatttacgaactccccttggtgcaaaattgagatatagatgaatgggtggctccctaagagaggaacggggacacctgggtctggtggaaccatgtcctgaaagcactatatgactttggcaaacagcactcttctctgggtgccatcccatctggtccccaagcagaagtcagagggtgcttagcagccatggcctggcctggctgcaaagggcatccagtcagcattgctttgtacactggagctttgaaccagtgatcctcaagcctctccagtcaggtcactgggaatttatactttcctaaaatgtccgttttcttgctgtttgcctcagaatgaaatctcacctcatgtgatagtagtcatgaaacccaaagacacaatgtggagaggagttcacgagaatgcctggtatgaggagagcaccccaaatcactctttatgagctcatctcaaatctcgggctccacttatcccacggtagtttttttgtttgtttttttgtagttataaagatataatttacatgtaataaaatttatttttaatgtgtatttcttcttttgaacatatgcttagagtcacactacaatcagataatgtttctgtgggacacccaaactttcctggtgccccttttttgtcatttttatccctggtctcccaactttagtaaccactgttgtgatttctgtctctatattttgctttttctagaatgtcatatcaatggaatcctagaaatgcaaacttttgagtctggcttctttcacttataatgcatctgagatccatcaatgtcgtcacacgcatcagtgcacgctgagtcgtattcccttgtataaatggaacccggtttattgtctcacctactgaaagggaggttgttgggttgtttttagtgatgggacatcatgaatacaaccagtagaaacgttcatttacagattttttatatgaacacagtgtagtgtttctgaattggatgataaatacgtgtttaattctataaaaagctgtcaaactgttttccaaaatagctaatctatttggaattctcactagcagtatatgagagttccagttgttccatcatattctcaccatcatttggtattgcctgcctccctcccttactcaatcttcttttttcttttctttttttccattatattctcaccattatttggtattgcctgcctgcctgcctgcctgcttgccttcctcccctccctccctctctctcccttcccttccctttttccttccttcctttcttttcctttcctttccctcccttccccctccctcttctctccctccctccctcctttctttctttctttctctttctttctttctttctttttcttttttctctctctttctctttctttctttttcttttttctctctctttctctctctctttctttttcttttttctctctctttctctctttctttctttttcttttttctctctctttctctctctttctttctttttcttttttctctctctttctctctttctttctttttcttttttctctctctttctctctctctttctttctttttcttttttctctctctttctctctctctttctttctttttcttttttctctctctttctctctctttcttttttctctttctctctttctttctttttcttttttctctctctttctctctctctttctttctttttcttttttctctctctttctctctctctttctttttcttttccttctttttctctttttccttttttcttcctttcctcctttcttgccattctactagatttcatagtgttatctcatacggtttaaatgatattaccttaattactaatatgttgagcttttttttttttctttacatgcttaaaatcttctctgttcaagtgtctgttcaaatcttttgactgggctctctttcaaaagctttccaattcaaattctatctttccaaaaatatgaattcattaagtctagaaagtatcgatcggcgtatttacaatgcctgtggatgcaatggcgaaacaaactcctagaacagattattttgtagtaccttaatacatagatattaaagcagtaatcaactcaagccagagtggattcactaagaatgaataatgtaaagggacccatttcctttctttttcatgaattaacttaattttatattagaatagttgaatagatatattttatttcatgcttgtgaacaaaatggagaaatatgaactgcgtaacaataggtaaattatattttgttgaaaaactattaccccaacatattaatctttttgaatctgtctagctggaggaatgttccttagtaattaaattcaaaataatgtaatcatcaaaaatattccaattaagtcaacaataattgttttataaatattattaaatgtgtatattttattcttattttagaaatatcacatattataataaatctggtatagtttcatgggagaaggatcctctgacattcatctcagaatgctatacttcacttaaagtttacttccttttgttatattaaccccacttcatgagatgctatttactctactttttttaaatgtgtatgcctcactttaatggtgttgcttttgttttttttaaaattgcttatctttatatttgagctttccttttacccggtgggtttaagtggcatactgcttgcttcagcctatttcgagtaattctgaggtagaggcaggacagattgcgaggcctgtcatgccaggagctgcaaagtctctccccttcttcctgggtcttggtagacacttgagtttctgccatgttgtcccttccacctccaggcgctgctcctgcctgagttctgcagccaagtgccctgtgattgctataagaaggaggaatgaggactggggggcggcgatgcagcaaactgaccagctgccacctctccattctcccagtcaatctctctgatcattgtctctgcgctagctcacagtctggaagcttggagagcctcttttgtttctccacttttttttttttctcagagttctctgtaaaagcatgttttgggttgtgctctcctgtttcaattaatttatatctaccctctgacttttaggaacttattatattatttgacaaagcacaaatgtgcagaaaaatcctaggcctaataaacccagatgttctggatgcagattcatgcttctctctcatgaaactccgcctcccaggccatcagggtgaaagcagggtggcagctgctgtgaggacagcgctgccatgcagcgctagagaccattccccacaccgcacctgctgccacggcaacaagcacccctcctgccctccccctttagaggatgtcatgtggaagttccataaaggcaaagaccacggagagctcatcagtggattttacccagtaacattttaaaatgtatttattccttcttcgtttggattttctgaaaacggagcacacatttcgataggcatcaagcagcctgttgatttcatgtgtactaactagcaattttcttcttatcagagatgcttattgaaacacgaggctttcatttcttaatacaatgacacctttttaatcagtcccgcacagctcttaattcaggagccagaatgtcagtgaataaagttctccttagaaagcagacctgacaattcctatggttcgtgaggcttcaccttcacccaggcagccatattgacaaaagccccaagtgtgttgcaaagtgggtgggtgccggtgttttgcctgcttcgcgttggaacacccgtcctctgtctggcattgctctgcagtaggaattttggtgggaaggaagaagttgcagaatctgagtcagcagagtctctatttctagatgtgcttgtagctactctatggacacctgacctagcttcttctaagtcagtgctcctcaactgagcacaagtttgaccccagaagtcatatggcaatgtcagcagacagtttcaaccataacgactgggagggagctgctggcatttagtgtgcaaggaccaggggtgctgcttacgcatactatgatgcatagaatgttcccacgaaaaacaattgtctgactccaaatgtctacagcgccaagcttgagaaaccctagtctcagttacagtacctgggagccagtggatctccagtgtcctgctcgggtcctagaaggagctgggagggggtagattgtggcctctggtgttctgtgatggcagcagcaacatttactcaagactcattctgggccgggcgcggtggctcacgcctgtaatcccagcacttcgggaggccgaggcgggtggatcacgaggtcaggagatcgagaccatcctggctaacatggtgaaaccccgtctctactaaaaatacaaaaaaattagccgagcgtggtggcgggcgcctgtagtcccagctactcaggaggctgaggcaggagaatggcgtgaacctgggagggggagcttgcagtgagccgagattgcaccactgcactccagcctgggcaactgagcaagactccgtcttaaaaaaaaaaaaaaaaaaaaaagactggttctgtgcctggcctttgttctgggtgttggcttctgcctggctgtcttagagtctatttctggtgtctcataaccattctttttttttttttttttgagacggagtcttgctctgtcgcccaggctggagtgcagtggcgggatctcggctcactgcaagctccgcctcccgggttcacgccactctcctgcctcagcctcccaagtagctgggactacaggcgcccgccactacgcccggctaattttttgtatttttagtagagtcggtgtttcaccgttttagccgggattgtctcgatctcctgacctcgtgatccgctcgcctcggcctcccaaagtgctgggattacaggcgtgagccaccgcgcccggccaataaccattcttaagttccgtgactcactagaagggctcacagggctcagggagactcaggactatggttcattacagtgaaaaaacacgcagtggcatcagcaaggaaaacaaatgcaccaggcagtgtctagaggagacccagcagtggcctccaaagtcttcctgtggatttgcgcaagacacactcactcctccagcaatgaacttcagtgatgtaagccaagtgtctaagcccagggagggcagcttgggtctcagaggctagagcttttatcaggagctggtcacacaggcacctatttccaggaggaaacgtgaccaccgtaaatcatgctattgacttggtacgaaccaactagataagcttgggcagcatgtgtcaggaccccgggtgtacaaaacaaccttattaattagcagcgcagggaatattgcagggccaagttttcaggagctggccaagggtcagttaggccttcctgaagagatgtgagactctggcactgtcaggcagctagctctttcctgcacactgcagttgtcaaaaacttcccagtcattctgtgctttcttcagtaacctttcagtgaagccctttctgctaaagtcagacaagttcagttatttctgcttccaaccaagaacaggagctgactcatacacaaggtaattcaaaaataataaccgaggcctcttgtgttgtttgcatggatcttgtatgcatgtgtgtgtgtgtgtgtttgatttgatttcaaaacgttatcatttctatcagaaagggagctttcttgaagacttcatgacagccacacatgagtccttgggctggtgttctagggaagcacattatctgcccgtggcctttaatgatatgcatttaaaatattttttctttttttaatagagccgaagacccaggacacaggcaaagactgcccatatcacatttttgacgtttgttgatatagagctctctgcccaggaaagactttagctccatctgtctgcatgttattacacatcccaggccacttaatacatccagcttagctgtggtctgaggtaccctgcttttcttaggtttgaaatgaatgcagctcatgcatgtaagatgtgtcataatctcttaggaagcaatatcaccactcaaaataatgaaagatctcggaaagaaagggtacgaatttgttggggaatatttagccatgttgtctgactttcttacccaccacgttttttgtttttcagagccattgaagataatgaagagatcactcttaaagtgctctttttttcttttcagattttaatagtaaagcagaactttaaaaaaaaataaagctgataaaaattattcatagattcatcatttagagaaaattgctgttaacattttggtatataatattcccatcaattttcttttcttttcttttttttttttttttttgagacagagtctctctctgtcgcccagactggagtgcaatggcatgatcttggctcactgcaacctccacctcctggttcaaggcattctcctgggtttacaggtgtgtgccaccatgcctggctaatttttgtatttttagtagagatggggtttcgccatgttggtcaggctggtctcaaacttctgaccttaggtgatctgcccgcctcggcctcccaaagtgttgggattacaggcgtgagccactacgcctggcccccatctacttttaaaacgtgtgtgtgtgtgcacatgcatacatatatacataatgtatataaaatatataataaaaacataaatatatatttatacatgtggcataagtgtgtgtatatagagatgcatgcacaggtagtcataatttatgcagcaatttatacataatgtatatcatgtaatcctgttgatgttcttctgaaacatgtgcctgtttcattgataccacatcgacctgcaatattcttctgcatcatggaagaatgtagaatggccgcatggtattccatctcatctcatacgatagtcagcacttccgttactggacatacaactgttaccatttatttgcagtcacatgtcaggctgtgattaacatgtttaatcaaatctatgtgcatatataattttacctccagactatatcttggtggtagaatttctgaaccaaagagtgagcacatttttcaaacaattgaaactcatggccagttatcctccataaaagttgttccaaatttcacacagtaggtcttttttcccatgaacttgccaatcttaatgatttctaatttttaaaaaatctcaacagtttggtgtttgtaagtagcttttcattataattaaaacaaccttgattgttaaggagtagccagaaaccctttaaacaaaaccttactggtattttttgtttgtttgttttaaatcaggatgtcagcctgtttaaatttaccaagtacatgaaaaggaaaacaaaacaaaaatttcttgactctaaaaaacccttagggtggtctacagcctgcatctctcttccatgacttccatgactgcatctgacttccatggcctcatgactgaggcctggggctgcactcagcaggacaggccaccttaggctgggcccccgggggcagtgccaggattgggactggggtgggactggttgacaggagtcttctcaaattatctgtgcatctcacaggggaatatatgggtgtgcttttttcctttgataggatggattaggaggactcagagtttttcttttgtgcaaggataacgatttgctccccaaattttgattgtctcatactcattccttttctaattatcccatatttgttaaatacaagataatagattctgacaagcaatcagcaaatgggcaccaagtgatgtgcttcattttaattggattgccttttttttttttccttctctgctaaattatagcccatcagcatgagattccctgtggtgagcagctaataatatgcccaggtgcagccaattttacttcctaaagaagaactagtagctacagatccccctaaagtgaagtggaaaagtgggctgtaatagctcgtctcagcagtgcggcatgctagggcaacttttacatccggatctctattctaacaatttttttttaatgcagtggcaattaatttgcattatattgatgaattaatgaggcacaggacagaaggttttcttagagacttctgagaaatctcttgtttaattttgccttagatgttacaatttttaaaaaatcttttttttaagaattaggaatataaaaccactatagataaacacaaatgaaaatatcactgttaaatgaaccagtgaaacagcattccatatgtattttccaaagtggtgctgggatgtggctttgctttggtgcacaaaccatagacaaatgtacccaatggaatgtcagttaggtttttgggaacacttttccctatttgccattaataatgtttgttcctatttaaaacattttagtgacttttaattagctacaatgaggtgagagtatatgttttaatctttatctaacttaattttatttttaagccacttgaccatgatgtgcagttttcagataaacccaaatattctttctgaggctgaatcaatagagattttcgtcatcacatactacacaccatctgtcacagccatctatctgttactctcttggtcaagtggccaccaatactcttgagccaacttgaaaacatatgggaaagacagtaaagggacaaggattaaagattcctgtcttaattcttgaacctggaaagaaaaaatgaaggaggagaaaacagaaatggagaaaacaacaatctcccctccctaccaagacagggagggttttcagggtgacctctcagtgtgtcttcactcagccactgccttccatattcctgccacattctggttcagttactattgtccacacatgtccttcttcccttgcagtttgtccatctccacacttcagccagagggattatcaaaaccctttgataacatataacagacatcctcatgctgtataacaaacatccccttaaaactgccattggctatgtttgtaaacatgagatttggacaggactcagtggagcaactcccgtctgctccaggatgcctaggacctctgctgggtagacaccaatggccagtagacagaaatctctttctcctcgcggcaaatctgacttgggatttgtagaggtcattgtcattcatgagctgatatttgcttctcttcagctcattgccaagtgtcccatccacatgctatctctagcatggtgctttctgggtagtcacacttcagggcttcaagagaatgttctcccaaagactggggtggactgcaaggcttctaaggacccgaacttggagatctcaggacctcacatccaccagattctcttggtcaagcaagtcagtaggaccagtcagaattcaaagagagaggggaattaaattataaatctcaatgagcagagcagcaaagaacttgaagacatatttaatttctataaaatcgtgttggatcatgtcaccctctaagcgtacaaccttccaaggcttcccattgcttttcagatagaatccagcactcaccccaaacagcctgtatgttcctgctgaccagactcatctcacaatgtgctctctgagtcctgctctgtgtatttcaaatccactgatcctttatttctctaactatggtggttgtcccacctcatgttcctctctttgcacactgtttagctaaagccaagctatcttccaagtctctgtttaaatgtcacttagtaggggcaacctccactgacccatgggtgcagtcaagcttccctgtcttagcatccagaattatcaaataattagttgtgtgatttagtatatgcttcactgaagtcccatgagggcaagggcatagtgtgtggttcagagctatttgcatagcacctagaaaactgtcctgcacacagttggcacttactaaatatttactaatgagtcaacattacattagccaaccttaggaaagagtgcttacctgtgcatctcaaatgacaccaactttgtgaaataatagtctcctgagacatgctggatctgcaccatccagtagggtagccctggccacacacagtgttgggcagtcaaagtatggctggtctgaattgagggtgccataaaatacataccctttttcaaagacatggtgtcacatcaaagggtatcaattgtctcattgatatttcatatgaattacatgtggaaatgataatagttttgatacgctgtgttacctaacagtattattaaaattgaaaactaggccgggcacagtggctcgcacctgtaatcccaacactttgtgaggccaaggcaggcaaatcatgaagtcaagagattgagcccatcctggccagcatggtaaaacccagtctctactaaaattacaaaaattagctgtgggtggaggcgtgcacctgtagtcccagctacccgggaggctgaggcaggagaatcgcttgaacccgggaggcagaggttgcagtgagccgagatcgcgccactgtactccagcctggacgacacggtgagtctccatcccaaaaaaaaaaaaaaaaaaattgaaaactaatttcacctgtttctttttacatttttatatgactttttgaaaatctgaaaccacatatgcagttcacatttatgtctcatgttatattttgtgggacaaagctgctctgaagagaaggttctagggtgaaatgtacttggagaaattctgcaagcactctcactctttagagggtttgcaatgaacatatcaaaagccctgagaagtcctgcagcaaaactgctgttaactctaagccagtgcatttcaaagctgactggaccttgcataggtctcatctttttaagaccttggatattcacctcccatgaaacacacttagggaaacatgattaggtgacggccaccctgatgcctggccctgaggtcgtggacatggttcatgtaaaactgaatcttattatgcagattagaggcagagcctatggaagtgcatttttattgggggaggggaggggatggaatcagacacaggagaagtgccaaattcaagcactttggcagaatcacacagccccacacataaagtcgtataagcacatatgttcccaccggaagctggaagccgcttctactctgatggaggggatggggccttgccagccccagggtcatgggcagcccgtgctgggctctttacagacatctagggctgttccttggtttgccttatttctctagtttgctcagtttgctgaaggggcaaaccaaaggtaggacacaagttcaggtccacaacggctgggtgcagtgtccgagatggaggggagaaatgtacaccgagtggccgtcagggcagcagatggtctgcaatttcctcccagaaatgtgggcatttttttctttctacagtaaagagtggatattgtctcgctgggctttctgaatttcatttttgatgagagatttaaatatgctgtttctcagcccagaatcctcgagatgttcgtgtggactatgtcccaagccccgtgcttgttttaaaggtgtttggttgtcaagaaaggtatcctgtgaacctaagaaatagtccgtctccctatgaggcaggattgtggcctcttttaaattaatcccacgtgaactgtgacctctttgttggactgtcaccagaatcatcttgatataagagcactgagtaataagaatctaaccagagcttgaggcagccgtgatagtctcaccaccatctgcccatcctggagctagactttcccaggcaaggcctgcctgtcctctgtcaaagcaaatgctggcctcccattagctcctaattctaataagggtttctattttatccacttacctctcctccagttgatatttcccaacatcttttttaccatcttccccaacaattcagtcctaacaatgctctccccttcctgagtcatctttccttttctcacagaagttcatcccttccacactgcaggattagaaagatcactaccttgtgttattctcacagagcagagatgccaagcatttccccacaagcataaatcttaattgccgtccttgctacaaatcataaataaccctagcccaggtatcattgcacagaaagccaggcaaaggagacagaaagccaggcaaaacataatgaaaaggtattaattgataactaaacaggtgttctatcttgctccagtacaaattttatggcaacaattttgttgaattgcttcttctggcattgaaaatttcatatgatgtgcatagtttcactctttctaaacccatctggggaaacaacaacggcaaaatcgtgatttaaaaatctgaagcaggctgggcgcggtggctcatgcctgtagtaccagcactttgtgaggccaaggcaggtagatgacttgagtccaggagttccagtccagcctgggcaacatggcaaaatcccatcttttctaaaaatacaaaaaatagctggtcatggtgtcacatacctgcagtccaagctatgcaggggcctgaggatggaggactgcttgagcccaggagctcgaggctgcagtgagccatgattgtgccactgcactccagcctgggtgacagagtgagaccctgtcccaaaattaattaattaattaataacaatctgaagcaattcaacttattcaaaacactttacccagaaagaacttgcaaattacccagggtgaaaacgagtggtagctcctggaattaataaccttaaatttaaagaagagaagaggtccctggtacacttcaaaccaaaattgttgtatcctttaagagtattgcaaagttaactttctaaatatgtgaatttatttaaatttcccaacaattaaaatgaatcaatgtttcccaaattgtgttccattaaatacttctcagggagagtttgaaagttctgcatttgaatatgggctttgatggtcaatagacttgaaaaatacctcatagtagagatctactaagaatacaacgcatacaagcacactaaaagtgctgagatattctgttgtcaacacacctgtttcacttcagctaaccttttccagagcttatctgggcacaaaacagtttattttgagctgtatctcttatttttccttagaacaccgtttaggaaatgagaaaatatacaatgttacctggtatacaatggcacggtttcttttttgttactctgctcaacacacctaaccatttctccctaattttaattttgcatataatcacaggatattttgctgttctttgcagtttcaaatatattttcaaaatattaatttttatccctaatgccagaaaaatacactgctatggcatttcaaaattgtagccatgaaatagaatgagatgtgatgtcatcacgtttttaggataatttctcactgccactagaaaaatacttcagcagaattcatgaggattatgtatattttataatcagtctcctcctaccatttatggtgctctttagaggtgataattctgtcttttgaagatctctggatcacaggaacaagagtgatggcaacaccaagagcaagccagggccctcctgaaactccccccttcctcactcactcttcactgcagcctctgagaagggaccttggccctgtaccaacttccttctccatccaaagtggcacctatggaatggcgcctctcaatgtgggaatattctaaccaattgctttgtattagttcattaccttgctgctgataaagacatacccgagacagggtaatttataaagaaaaagaggtttaatggactcacagttccacgtggctggggaggcctcacactcatggcagaaggtgaaaggcacgtcttacatggcagcaggcaagagagaatgagagccaagtgaatggggaaaccccttataaaaacatcagatctcatgagacttattcagtagcatgagaacagtgtgagggaaacccccacccgcccatgtttccattacctcccaccgggcccctcccatgacacgtgggaattatggcagtacaattcacgatgagatttgggtggggacacagccaaaccatatcatgcttcttttcatttttcccctaaagaaagaatatcgctttctaaaaagatgaaatccctgaaaagatggaatttatttcctaaaaaaaaaaaaaaaaaaaatcagaattaaagggagaatgaggcatatgaaatttggatccaaataacttgaagcacatttcttatatatgatgttctttgtagaattcctttgactgattggaaccatttatcttgctgtgatttcacagcacaggcataattgtgattgttttattagttctttttgctgattaactgaaacataattgtgctttttgaaaaaagagtgtgaagttagttgatttctgaaaaggtatgtaagaatgtaaacacgaggattcttaatatcagtggaagaaaatgactcagtggtgggactgtgttttcacactgctaataaagacatacccaagactgggtaatttatacaggaaaaaggtttaatggactcagagttccacgtggctggcaaggcctcacaaacatggtggaaggcaaggaggaccaagtcatgttttacaaggatggcagcaggcaaagacagagcttgttcagggaaactcgccctttataaaaccataagatcttgtgagacttattcattgtcacaagaacagcacaggaaagacctgcccccatgattcaattacctcccagcaggtctctcccaaaatatgtgggaattcaagataagttttgggtgatgacacagccaaaccatatcagactgaaaacagagcagagagatgttcattccatggaagctaaaaggtacatttgctctgagctgtgagctcgcatacagaagtgggctgctcagctactacagcccaggtcacactctgctgtctcctggctgtgtgaccttgggcaccttctttaactcccatgcacccgtttggtaaaacttggggctggcctgggttggaggccaaattcaaccacaagccagccaatgttagccagctagaggatttgtacttgacaaatatttgtgtttgactgttgacctgggcaatgtttaaaaatttattttgaatagttgccaacactaaacattttaaaggtaacataaaatctggatttccagctcctctggaagaattataaatctggcaatgcaggctctcattcccacctggcagctccagcagtggctttggtgctcttcactccagctcatcaatgtccccatcaccccctcgtggccccaacaccaacactgagacagagtaccagctgccaattgtgtggctgtctctttattataattcagaagcattaaatgatttatgatattcatattcctatctaaagtagagtatttgtttaaagaaaaatgaaatataacatttttatggaaataagaatgtgcattggctgggcacagtggctcacatctgtaatcccagcactttgggaggccagggtgggtggttcgcctgagttcaggagtttgactccagcctggccagcatggtgaaaccctgtctctactaaaaatacaaaaattagctgggcgtggtggcacatgcctgtaatcccagctactcgggaggctgaggcagaagaatagcttgaacctgggaggtggaggttgcagtgagctgagactgcaccactgcattccagcctgggcaatacagtgagactgtcttaaaaaaaaaaaaaaaaaaaaaaaaaaaaagaatgtgcattaagcacatatataagtgaagaacatattttttgtttaaaacccattcacctttgctcatgtttactaatgtcttggcccctgatggcctttcattctgtagcctgtatagagcagggatcagcaaaatggggctcacaggccaaatgtggcccaacccctttttttgtaaatgaagctgtattgggacgcagccatgttcacttattcgcattttgtttatggctactttcatattacaataggacacttcaggagctgcaatagagactctgtatctctcaaagccaaaaatatttatcatttggcccttcgtaagaaaaagtttgctgactttgattttcagcgagggcacccagagagcttggaagtgattactcctgggctcataacatgaaaaaaagctgaacagaatgaaaatctatgacttttctggattcatcagaggattgaggtcacagggcaaaccactggtctgcaatctggagagacaggtcaacacagagaatgagagccaaggtcagcttacagggggcagaagcttgcggagccagtgattggtaggaacacgtaaatggtaagttcaatgaattgctggagactaagtatgtgaggcttgagagttaatatttcctaggagcccctacagctttcttgagtttttcctccaggaagctcaccagattctcacatgaaggtcagagaaaaatcccctccagttctgagcatgggaagtgagaaggtaagtatttgaagcaagcccattgcattctctataagaaaaccatgtccttcaaggaaggctaccttaccagaacattgtccaacttgaggaaaggaaaattagccactggtgcccccttctatcctgcctgcctcacataggaggaggaagaaaagctaaaaaacaaacaaacaaataaacacaaccacaaagcacatctgaaagtcacaatccagggacttgggtatactgcaagctgagattttatcttaagagtatggagagcttcctctccctaacacctcagcatcacatcaacaaggctccaaaataataccagtgaattacagctaagagagctgcaagatgcagcctctattcaagaatgagttcctagggaaacacaaagacaacaagagagaaaagtgagataaagaaactaaaggctgtgtcacctgcagctacatcaaacattaaatacagcccagattcatgtaaaacctcatgctaaaagtctaattatattagctttcattacccaaatactgtgtctgactctcaacaaataatgacaagaaatgaaaggcaagaaaaaatacatatgaagagacagaataagcatcagaaccagactcatatatggcagtgattttggaattattggatatggaatttaactatgattaacagaattagggttctaataggaaaagtagatgacaagcaagaacagatggataatgtcagcacagaaatggaaactctaaggaagaatttaaaggaggtgctagaactcaaaagcaatgtagcagaaataaaaagtgcctttgatgagctcattaatagactagatataaacaagaaagaatcaatgagcttgaagatacgtcaggagaaactttttaaaccaaaatgcaaagagaaaaaaaatgaatggaaaaatagaaacagactgttcaagtactctgggacaattacaaaaggtataacacatgcagaatgagaatcccagaaaaaggagaaaagggagcagaagatatatttgaaataacaatagctgacagctttccaaaattaatgatagacactaaaccacatatccaagaggctcagaaaaaaaaaaaaaaaaaaaagaaatgcaaaaaagtctacacctaggcatgtcatatccaaactgcagaaatctaaagaaaaagagacaatattgaaacaagccagagaaaaacaccttacctgtagagagacaaagctaagaattatactggactttttgccacaagctacacaagtaagagagtggagtgaaatgtacagtattgaacaacaacaacagtaacaacagcaacaaaaaacccaccaagatagaattctctgtctacataatgtttcttcaaaagtgaaggagaaataaagatttttgtcagacacaaaaaaattgagggaatttgttaccagtaaacctgcctttaacatttaagaaaggttaaaagaatgtattcagaaagaagaaaatagcatgggtcagaaattcagatttacataacaaaaggaggagtttcgtaggaataaatgacagtaaaataaaatgcataagcagaattagaaaaacttgctgttatagttaggggcttcagcacccctctgtcagtagttaacagagccagcagacagaaaatcagtaaggttatagttgacctatgtaacaatgccatcaaacaactgaatctaatttacattcatagaatacttcatgaacaacagcagaatgcacattctttacaaattcacatggtctattcaccaagactatattctggactataaaagacatctcaagaaaattaaaatcatagacatcatataaaatatggtcttgattataatgaaattaaacttcaatggaattaaatttaataacataaagacagctgcaaatctctaaatatttggagaataaaaatacacttccaaataacacataagtcaaagcagaaatctcaagggaaatttaaattatttgtaactaaatgaaaatataacctatcaaaatgtgggatgcaatgaaatcactgcttcacagaaaacttataacattgaatgcatagattagaaaagaaaaaagatttgaaatcaatagtcgaagcttccaccttagaaaactggagtaagaagtgcaatatcagcctaaaacaagcagaagaaagaaaataataaaacttagaccagaaatcagctacattgagaccaggaaaccagtagagaaaatcagcaaaactaaaatctggttctttaaaaatgtcaataaaattggtaaacctctaacctggctatcaagcaaaaagaagacatgaattattaatattggaaataaaagagaactcatcaggaatgctttcatagatgttaaaaggataataattaaagggataatagggttatgaaaagccctgtagccataaatttgaatacttggatgaaataaactaatttcttgaaggacacagactatcaagatttgtataaggagaaacagatattctgaatgggcctatatcaatgaaagaaattgactcaataattaataaccttccaaaaaagatagcatcaggcaccagtgtttgcactagtgaaatctaccaactcttaaagaaaaaaaatgataccaattctttgcaatctcttcctaaaaataaaagctgagctgacgttatgtctcatgactatgatctcagcactttgagaagccgcagcgggcggattgcttgagctcaggatttccagaccagcctgggcaacatgacaaaccctgtctctacaaaaaatacaaataattatctgagcatggaggcacatggctatagtcccagctacttgggaggctgaggtgggagaattacttcagcctgggagacagaggttgtagtgagcagagatctagccactgcactccagactaagtgacagagtgagacccaatctcaaaaaaaaaaaaaaaaaaaaaaaaagtagaagcagagggaacatttgctaactcatttgatgaggccagtattatcctaaaaccaaaacagataaagacatcacaagaaaactacagatcaatagctctaatgaatttagatacaaaattactcaataaaatactagcagattaaatccaacaatgtataaaaagaataatgtaccatgatgcatttggatttattccaggtattgaaggatgctttaacattagaaaatgaggaaatgtaacctatcgcattataataggctgaagaatgaaaatcatatgatcataacaacagatgcaaaaaagaatttggtaaaaccggcacttatttatgataaaaatgtctcagcaaactaggaatagaggggaacttcctcatcttggaaaaaagaatctacataaaacctataacagacatcatacttaataatgagaaaataagtttcttccctctaagattggaacaagtaaaagattttccttttcatcactccttttcaacattgtgctggaagtctgagctaatccaggaaggcaagaaaaggaaataaaatatatacagattgagaagaaataaataaaattgtccttgttcacagatgacatggtagtctatttgaaaatctgaaacagttaacaaaaaaatttctggaattaataagtagtcatagagggttgcaggatacaagactaatatatgaaagtcaattgctttccaatgtaccagcaataaacaattggaatttgaaatgaaaaaccaatataatttctattagcaccaaaaaacccacttaaatattaatctaactacatctggacagtatttacatgaagaaaactacaaaactctaatgaaatagacaagatatatagaaatggagagagattctattgtcatggacaggactcaattttgttacgatgtcagtttttctcaacttgatttatagattcagagtcatcccaatcaaaatctcagcaagccaatttttacacattgaaaaactgattctaaagcttacatggaaagctaaaagacctagaataggcaaggagatactgtagaagaaccatgagagaactgacattacctgacttcaagacttttggtaatcactagcttctggtgttggtggaagaacaggcaagtaggtcaatggaacagaatgagggctcagaaacagatgcacacaaatatattcaactgaatattgacaaaggaacaaagacaattcaatggggaaaggatagtcttttcaacaaataatgctggaacacctgaaaatccatgtgtgaaagaaactagacacaaaatttagcaaatattttacaatacgtgctttaacaacaacaacaaaaaaactcaaaattgattagagacccacatataaagtgcaaaacaatacaactactaaaagataatataggaggaagtctaggtaaccttgggtttggttttgactttttagatacaaccgcaaaagtatgacgaatgaaaggacaaattaataagttggtgctatggtctggatgtatgtgtctccccaaaattcatatgttgtgatagtcttaggaggtggggcctttgagaggtgattaaatcatgaggtctctgccctcgtgaatgagattagtgcccatataataaagaccccagagagctgccttgtctcttccaccatgtgaggacgtagcaagaatcaccatctatgaaccagaaagcagctccacacaagacagcaaatctgctggtgccctgatcttggactatccagtctccagcactgtgagaaatgtcagttgttcataaattacccagttgatggtattttcttatagcaacccaagctagctaagatagtttgacttccttcaatttaaaaacttctgctctttttattgttgtatctctgccaggttttggtatcaggagatgatggcctcataaaatgagttagggaggagtccctccttttcaattatttgaaatagtttcagaaggatggtaccagctcctctttgtaactctgtagaattcagctgtgaatccatctgattctgggctttttttggttggtaggctattaatgactgcctcaatttcagaacttgttattggtctatccagagatttgacttcttcctggtttcatcttgggagggtgtatgtgtccaggaatttatccatttcttctagattttctagtttatttgcatagaggtgtttatagtattctctgatggtagtttgtatttctgtggggtcagtggtgatatcccctttatcgtgttttattgtgtctattcttctctcttttcttctttactagtctatctagcaatctatctattttgttaacattttcaaaaaaccagctcctggattcattgatttttttgaaggattttttgtgtctctatctccttcagttctactctgatcttagttatttattgttttctgctagcttttggatttgtttgctcttgcttctctagctcttttaattgtgatgttagggtgtcgatttgagatctttctggctttctgatgtgggcatttagtgctataaatttccctcttaacactgctttagctgtgtcccagaacaatgataacacatggacacagggaggagaacaacacatactgaggccagccagggggttgggggccaagggagggagagcattaggataaatagctaatgcatgtggggcttaaaacctagatgacaggttgataggtacagcaaaccaccatggtacatgtacacctatgtaacaaacctgcatgttctgcacttgtatcccagaacttaaagtaaaataataataataaaaaaaagccttctgctcagcaaaagacacaattgaacaattgagaacgttaaaagacaagccaaagatggagagaaaatctttgtgaaacacatattggaaaaagacttgtatccaaatatataaagcagccttaaagctcaacaatgtgaaaacaaatgatccaatgttaaaaaagaacaaaagatctggaagatcacctcacctaagaagacacagaagtggaagataaagatatgaaaagatgatcagcattatatgtcgttaaataattttaaattaaaacaataacgagatactactctatagctactaaactggctaaaattcaaaaaacttacaatatcaaatgctgatgagatgtggagtaacagagacggcagagtcactttaaaagacagtttgggccagtcgcggtggctcacgcctgtaatcccagcactttgggaggccgaggtgggcagatcacaaggtcaagagatcaagtccatcctggccaacatgatgacaacctgtctctactaaaaatacaaaaattagccgggtgtcatggcgtgcacctgtaatcccagctacttgggaggctgaggcaggagaatcacttgaacccaggaggcggaggtttcagtgagccaagatcgtgccactgcactgtagcctgggtgacagagtgagactccatctcaaaaaaaaaaaaaaaaaaaaaaaaacagtttggcagtttcttacaaactaaacatagtcttaccataggatccagcaatcacgcttcttggcattcatgcaaataatttgaaaacttatttccccgtaaaaatctgcacatgaatgtttactaaaggcaaccgaactaaaatcaaccgaagtgttcttcagcaactgagtgagtgaactgtggacttttactcagtgatgagaagaatgatccatcaagctacaaaaagatcaggaagcaccttaaatgcatacagccacacaaggaaagcaagtctgaaaaagccacatcgtatgtggatccaaccatatgacattctggaaaaggcaaatgctgagacaataaaaatgtcagtgactgccagggatgtgaaggtggcaggtggggaaagatgaacaggacaaaccccagggatttgtgaggcagtaaaactattctgcatggcactagcatggtgaatacatgacattatacatttgtcagaaggcacagaacgtacaacacacagagtacagcttaatgtaaatcgcggcctttagttaacagcaaattcctcacactgttgcaagatgttcataatataggaagttgagtataggggagtggcaggggacagtgcatgggagctctctctactatcgcctcaatttttctatacatctgtaactgttctaagaaataggccgggcactgtggctcacgcctgtaatcccagcactttgggagactgaggcggatggatcacctgaggtcaggagtttgagaccagcctgcctggtcatcatggcaaaaccctgtctctattaaaaacacaaaaaattagctgggcgtggtggtgggcacctgtagtcccagctacttgggaggctgagggggaagaatagctagaacccaggaggtggaggctgcagtgagccgagatcatgtcactgcattccaggctgggaggcagagtaaaactctgtctccaaaaaaaaaaaaaaaaaaaaaaagcctattactgtaaaaaagataggttaaaaaaaaaaaaaaaaccggcttgcaaactttgatttagaaccatgaacctttttatcctaaaactctgtgaaatacttagtaccccatttctgtcattaaaccaacaaaggagacatttcgtttgaagaagatattttcccaagaaataaaacataaatatgaaatacacaaggtcatgtaggaaaagtagattatttttctttaccctgtgaatattgctctcagggtgtagcagtgccctccagtcaggcaaaaattagttgaagctagtaatagccaacctggcttagaaataacggctaaatatatgcattatgttgtgagtgcttactatttattgagagtgtgttttattagatttgggtttctgaaaatgtgataaattaattgggttggtaaaattaactagcaaaaatatttgtaaacagctataatcttaattacaaatgagtttataaactttcattttttcattttaagggaaaagacaagtgtagaagatgatgctgtttattttatttttaatataacatcatgctgccttacctattatcttttgatgaattctggaatactgaggaacatgagcatatatatatatatgaaatatttgtaaaatgaggaaactgggagctattttatttttccccaagagtgattttcagctataaaactgtaatgtggtcaggtcgtagatcacataaaaatcattctatgtttcccttaaaattatctaaatagagttcactagtttttcttaatgtgcacatttcgtatcacccagtatggtcaggggtgcaggaggtaggtcatcttcaagacattttcttgttgcaagaaattaccacaattctgtgttctgttgttcttgtttttaagatatttacctgccaagcatacggcataattatactttccaacctctccaattaagaaagaacttttggttctttgtgctgtggaactctgagtagataagatgttttttcttttagctaactgaataatacccacaaaattcaataagctctttgacaaaaatggccattgagggcctctgagtcaccttacgctcatcaactcccacccgtcaatgaatatcagaatatgggctctaatatgctttaaaattagtccttccttaaaaaggtgtcatgtaggggaagcactcttatatttgaaagcaagtatcagaaagctggagagtggtaccgatcctgcagatataaaaatatctttagtgtttttctaaaacatctacttttctaggtagtacctgtctattattaggggacaagtgagtcagccgtgttgatgtgacgatattagggtccttcttgctacaagctcatgtgccattttaaggcttacccccagagcatgggctcagcaaaccactgcagagaaaacaggctggtcctagtgctctgccttgtgctagttcttgcgcaaaggaaaaccacaggccagcagggcctaagaatcagtccagacacgcacatgcactcacacagagcacagaggccacagtttgccgcctgtggatcccattaccaacagggatgactttaggtaccaggatacttcgtctcattcaggtcaaaacttttactttgcctaaagcatttctcattcgcgatgtttggatccaaagactgtagtaatgctacaacttgcttgcttctttgctattttcctttcttttaaaaatggattctcatcagaacatccctttcaatgtaataaactatatttggatctgatcctcttataaattggaaccagagtatgtggttaggttgtgcctcatcttttctgttgataagtgttttatgtgaggaggttcagaagagctgactttcagctacaaaggttgtgttcccgttcctgaggcaaacagcaccctggccttcagggcagagcttggctgggcctttaagcactgggagtcttttgcacaccttcgaatagagatggctcttggaaacccagtatgtgcctttccctagcaatttctcttttcttttcttttttctcttctctcccttcccttctcttttccttccttccttcctcttttcttttctttttttttgagacaggatctcactttgtcacccaggctggagtgcagtggtgtgatcagggctcactgcagccttgatctcctgggcgcaagtgatcctcccacctcagcctcctgagtagctgggactgcaggtgtgcaccaccatgcctggctaatttttgtattttttggagagacggggtttcaccatgttgcctaggctagtctcaaactcctgggctcaagcaattcacctacctcagcctcccaaactcatggaattataggcatggatatggaaagaaatgcatagcagatggtaaaataagaaggaaacacaattgcacttggtggcaccaaagaaggcctgccctgtgctgcctgggctagggggacttcagaaggtgtcctatttgaaggtgcacccagtaagtgttggttgctcacctcacccaatacctacctgtccttccatcagggagcacatagaattgggctcaagagcatgaaacattctcaagcgatatctctttagcatatggggttccctctacaaagactgaggttactgtcttggcatcagcctcccctcccctgagtaacaccaaaaacacaatcatttgttccatttgctggacccagttgagagcccacatctgttactgtagacagtcaagtttttatctacatacaagttattgattatctacaagttattgattatgattatggcatgcgaccctctgttcacacctaactgtgctccagcatcctctttaggccatcatcccaacattatctctatggctactctttattaccccctaccctgtgccaaatattgtgctaactaatggcctgacagctgttattttattgaatactcacagcagtcttgagacagtcgttagtgtttttatttttcagatgataagagtgagattcaaagaatacaagtatcttgcccaaggtcatattcctgaaacgacaggccaggattactgcccaagtgagtcctctttaaacccaggttcctgtccgctattgtgataagctatgtcacactgtaaaattagtctgctggttaccttccagggactcatggctttgcagaatctccacccaccagccacacatgtccagactctattgcacagtgtattattgttccaaatctaggattgattaatattttcctgttttacctttaagaggatgacccttttttgactttatcccaataagttttgaggtaggggcatcttcctacaggccttatggatgaaaataattctccacaattttaagtatgatagccacctgagattaactgaaaaggggcttgtaagaaagcagaattttgtttcaaatatagggggataaatgaatggacctaagtaactttctgaaaaagcataaacgaaaacaacaacaacaaaatatgctatttaacctgtgttcataggagtcgattaaaaccttctattttggaacatgagatttagcggaaaacatctgtagataggtagcaaatgttagcagctatttaagatgtaagtctgacttactgatgaacatcagaaatggatcactcggtcgcttggaaattcaacctccatttcctgtgtgtaaagtaagctgaactggctcagactgagcattctagctctgaatagtaaaataacagtgaggaactcatgaccatgatacatgatgctttcagataattttaaatagttttataatattgaaacatcatagcctggtatagtggctcatgcctgtagtcccagcactttgggaggccaaggtgggtggatcacttgaggtcaggagctcaagaccagcttggccaactggtttcaccagtaaagatggtgaaaccccatctctactaaaaatacaaagaaaactaaccagttgtggtggagcatgcctgtagacccagctactcgagaggctgaggtgggagaatctcttggacccaggaggcagaggttgcagtgagctgagatcatgccactgcctgccagcctgtgcgacagagcaagactccatctcaaaaacagaggaaaaaaaaaaaagagaaacatcatgaaaaggtgaaggattggaatgctgatagttgaggctacaaaaccatgacataagtctaggagtttggcctttattccaaggaccaacaatttcaagaattattaatagcacagacttaataaaaaaaaattaaaaaatccttttttgtgaagttccaatatataaaacatatgctttaactcttaaatagtgtagtttaagttaacaggtttctaaggcagtaccacacttcagtttagggcagaaaatacttttagtactaattttgaactctaatccagaaactattttggctcttcaaacatttaacttcgtcaaatgtattttgttttgcatcttttaaaacctcgtttccatttaatcactggtacaatatctgcaattcattagctcaacaaatatgtgcgtgcttgtgagttcttctgaactcttaagggctggggacagcaataagttagaattcgatctgtgtcttcatggggcttatattctgtgagagggaaggacaataaacatataatccatggtgatacaagtgcggtgaagaaaataacccagagtgatgctgtagagatgacatggggtgagggtgatggatgagatggtcaggaagggttctccaaggtctcccttggcaagtgacatctaagtcaagacttgaatgtgaaggaagaagccagaaggaacagcatgggcaagcacacagaggcaagaaagagtttggtgtattggaagaacaggaagaaggggtgtttcggagtggacagttaaggaagtggtcagtgaagtgggagagacagggaggggtgaaaccactacaccttaaaaatgatagcgaggtctttacattttatttcaattggagcaggaagccattgtccaaaaccaaataataacttgaccttttgcttcctatttgagtctctttaacttattaaaaataagacatacaagctcatatgagtatgtgatatttgatagatattgagttaatatagtttatcagatatttcaagtatttgaagtatccttactgttaccttgccttaggataactacctaaactccttacagactaattgcattatcagagtaatttctcacctgaaaaatttaacattttatatatgcaaaagtcagattgaaaaagaaaacaaaattgtacttagctctaaaactttaatggggtattactgccttcctggatgttgtagaccaccttcttaaatgtgacacatttagcaattctgaatgccagcaggatgttgtagactaccttcttaaatgtgacacatttagcaattctgaatgccagaaggcagctgggccatgggggagagtcctggctaaggtcaaagtaagaccctgtccctttcttgctctttaattcttgggcagataatgtagtttctatgacacataattccttcatttgtaaaatgggtccaacaagctaatacatattattggtaagctattagaaatcgaatgcattttctccaaatagcctgggccatttgtattgccaacgtatacttggcatatggttaagggattgaagtgaaaaatattaaattagaattcagtttgtccctattataactatgaccacttcttgggaacaaccctagagtttatgtatatttataccttgttacctcactttgttctttccaaactcatttttaatagaattattccaagaaatttaaccctagtggacactttctattccacacaatataacataccctcacaagtacactccttttatctgtttcaaatgtctgtcatactgggatagaaaacaagttaacatacaattttcctctttacttatatcgaatggtaaggaggcttttaacaaatggctttatataacaactagtattgcgtgtttaggtaacaggtggatactcagtactttattggcaatggtgatgagggaattttgatcttggaattcccagcctcctgaactatgaggaaaaatatttatgttgtttataagtgtattattctgtttccagactgggtaattaataaaggaaaaagtcttaattgactcacagttcttcatggctagggaagccccaggaaacttacaatcatgatggaaggcaaaggggaagtaaggcaccttcttcacaaggtggcaggaaggagattgaatgcaggaagttctaccaaacacctaaaaaaaatgtgatctcgtgagaactccttcactatcacgagaacagcatggggcaactgcccccatgattccattatctccacctggtctctcccttgacacatggggattatggggataatggggattacaattcaagatgagattttgggtggggacacggccaaaccatatcaataagccatggcattttgttatagcagcctggacaaactaaggcagttggttagaatacatgtttttaaggcaaagatgaggaaagggaagaatcctggacctcaccatgataaccagatggtttagacagggcaatacccctctaagatgctgcttcacctgagaaatgaggaggataatattggtacaggactttcagaagtgagataatgttcaaaagttacaaaagggagacccaagtatagtctcttgttagtttcttagtatttttgactttgagatttattttttaaagtaatagtaagtgacattattattgctattactagctatatcatctattggctggttactgtcaccagcactatacaaaatcctttaaatatgttacctcatttactcctcacagtgacaccattaagtcagagctgtttccccacattttacatgaggaatctgaagtcagagagtttaatcaactttccccatgttcacactgggagcagagtggtggagatgggatttaattccagctgtaaatgcatggggcagaacccctgcaggggctccatggctcattaatgtgcccctctggcccaagcatgggttaagaaagtggacctaatgatagagcactaaataggggatattcgaatcttgcatttatcaaagtgccattgtccatatcatgttaatattttatatttacatacttccatgtaagtcgcagacctgggatatgaatctaggcctttgagcctaggcttggtcttccctgtgggtaaaaatcctgttgcactttgggtctatttcttagttacattggagattcatattcagtgtttggaatttcttacaaaatgacggaaactgcctactaattcccattgattgaagacacaatatctaccaattcagttctcaggaagaggagttattaggtttaaatttatttttacatcttaaaagaaactgctgagtgataggagaggagagtgttaacttggagtgacagattaaaaaaagtgagccagttcatttgtacataatttttggctatgttatccagacataagctaccagaggacaaagcagtgtaataaatctaatattctcaaatagtttgtgtgcagaagtttagcagtgaggatggttttgtaatgaccgcacatgctagattgcaaactccattcttcactattcatgtacatttgatgtcatatacattgccaaagatgatttcaaaaatgccaagcttctagtctcactttccttagttatgataccttatatcttaaaagggtggtaatttattagttggttttttgttttttgtgtgtttttttcttttctttttggagatggagtcttgctttgttgcccaggctggagtgcagtggtgtgatctcggctcactgcaacctccacctcctgggttcaagcaattctcctgcttcagcctcccaagtagctgggattacaggcacatgccaccacacccagctaatgtttgtatttttagtagggacggggtttcaccatattggccaggctggtctcaaattcctaacctcgtgatccacccacctcggcctcccaaagtgccgggattacaggcatgagccactgtgcccgaactaatttattagtttttattatttcattttgtttagatagaaagcatggagttaaacattaattgtactgtattggctgccaaagcatagaaattgtattttggaggtgagagctgcagggtgggttgctgtttcttcactgattattccccatgagaaaaaagtgacttgttgattgcaatttcgttgtgaataatagttattttcatggtctttggaaaacaagacagagaagtggagagggatatggtagcacggctgggattgtcacaggaaataacttgccccagtctactttttttcatacacatacagtttgagttcctaattaatcagttgaaaaatccagctcctgaaaatatggctacagaatactgatcattgattgtgattcattttgcttcacataaatggttgcattttcttttcaatgagaataaagtttttctttttcttcctctgtcaacataattccctttgttcttattcagttttcttgttaaatgtttttccacatgtagaattttacaaattgaataatacatgcagaaaaaaagaaaaacaacaacctgtctttttttctttcgtctaggtcatgggagaatgaaaaactagaatcttcatgagcattccatactaaatatttgtattagattatcattatttattactttgctaaacaaccatttttatccatcactttttatgaatctatagtaaaacaaaagtaaacagcctccatgctttcaacaaggagagtctgttgctctaaaaatgtccatttcaccacagtttttcctcatcaccacttgctgaaacttactgcatttgttcatgtttattataaagacttttgccatcctgctcggtatttaagattcatcacaagggtattccccctttagatgttctgactaatgttgatattaaccatgtgacattcacaaagtaattttttcctgaatatatgacagtatatattaggttggtgcaaaagtaattgtgatgtttgccattaccttttaatgccaaaatccatgattttgagccaacctaatatcagaggggtaggtaatgcaattgtaagtgagtgttctttggagtcaggtagatcctgcctcttctcagagcagctgaggggcccgccaaggtctgtggctgtaatcctgagtcatgtggatcaggaacgcctttaagtccatgcctggcagctgaaggcatctgcagtttagattctccttgtaccaattttgcaaatctctgcaatattggaagccatgcacccagctgaatggaagcaggtgaaaacaaggccgcatgaagtcatagcactgtgggcagcagtgcaccagtagtagctctttgtgctcaagaatcaaatgatgactgttggcagggattaaaactggggctgactgagtgctgggctttgatcttgccaaatccactgagacagctgaaatttcatgaaaaggtgacaaggatttcctaaaccaaatgcaaattgatgtttaactttcaactccagctcacacccaaaggctttgcaagtgcttgaaaaaagaatatctggcttgtacatcagaaaatgacctttacaatatattttatttgggctaaaacttgtgctgcagcatcactgaaaaaaattactcttactatttaaatgattatacttttcataaaatttcaatgacagagatgctaagtagagatgatgtttattgaaaggcattcttaaaatttgagaaggatttatcaaatgataaacaacattttgtgataaagactatgcattcccacttatttggtaatgcagccagttacggggtacacaccatttttttctttaactgatgtgataaaaaattgtataaaacttaataaacattttccaacatgaatggatgctgtaattaacctatactcactaaaatcagtgtgtggattagcattgtattgggaaaaatatgtgattatgtgagttataacccagattttgtcatgaaaattagatgcttaaagctaagacatgaccctagtgttctcatcagaaatacgggtagatacaaattagatgattttgaggtaattttcagttaaaagtctctgatacatatcctttttcatatcctctccaatggacccttgtttcattgatgagattattacacgtattaattcgctcccaaagccttttttgtatgtttgttgatcacaagattattttaagtataataattttactagatttaaaaattatttttgaaaaggttgtgtcctctaatgtactccttgaattactcatctgctcttctttatttttgtatctggaattagtgccttgttttcctttttagatgctgtgtgatgtggttactgccccaaatgttcatatttgctaccacttagagtccagccttcttctgttgtctaattatatgctattaagactgtcatattgtgttgttaggtacagaaatttgctttagaaacaaactgaggattgcgtaagtattgacatggcagggtagtgttccatgtgtttcttgggcaagttgggtttcaagcatggatctttgtccacacctctcgcaccttcttggaaatatatacagcaatgtcaccagaaatatcttgcaccttaaggctgtctgtcactgtcagcatcacttggaagctggtcaggaatgcaaaatctcaggctctacccagatctcctgaatcggaattgaactttaacaaatcctctagtgattattatgcaaatgaagtttgaggagcgctgggctgaaacatccttctccttcataacagctttgggtggggtgcttctgaacactctttcccaagatgcagtgttgtcattttccttaatcaactctgtctctgggacacagaacagtcaaacaagattttctgtgttagtctgcttttatgttgctgtaaaggattacgtgagactgggtaatttataaagaaataggttcatttggcttatggttctgcaggttgtacaagaagcatggtgccagcatctgcttttggtgtgggcttcaggctgcttctgttcacagtggaaggcaaaggggagccactgcacagagatcccatggcaagaacagaaacaaaagagcacggaccaggcatgttggctcatgtctataatcccagcagtttgggaggctgaggtggatggatcatttgaggtcaggagtttgagaccagcctgtccaacatggtgaaaccctgtctctactaaaaatacaaaaattagctgggtgtggtggtgggcacctgtaatcccagctacgcaggagactgaggcaggcgaatcgcttgaacttgcgaggcagaggttgcagtgagctgagatagtgccattgcactccagcctgagtgacaagagtgaaattccatctcaaaaacaaaaacaaacaaaatgagcacagggaaggtgccaggctctttttaacaaccaactctcaggggcactctcatgggaactagtagataaataattcattctttactgcaaaaacaccaccaagccattcatgagggatccactcccatgaccaaaacacctctcactaggccccacctccaacactgggaatcaaatttcgacctacaacttggtgaggccaaactatatccaaaccgtaacaccctcttatttggtcagtcactactgctgagaggtgggtggaataattcttcattcagcattaaacaagaaaaaatagatcctctctgaaattgcccatgtattttgctgtgctttaaaaaagacttgtagatctattaccacttgtaaacttttgcatatgtgttcttttaagcatttttcttttttttttttttttttttttttgagacggagtcttgctctgtcgcccaggctggagtgcagtggcgggatctcggctcactgcaagctccgcctcccgggttcacgcagcatttttctttaacactcaatagagtatcttcatggatctaatgagctccaatatttcccatctctccaaccctttttgtgcttgtgttagtccattttacattgctgtaaagaaatacctgacactgggtaagttgtaaaaaaaaaaaaaaagaagttgatttgtctcgcggttctacaggctgcacaagaagcattgccccagcatctgcttggcttctggtgagccctcaggaagcttctacttgtggtgaaaggcaaggtgacatggcctcccacatgacaagagaggaagcaagagcgagaggagggtggtgccaggctctttttaacaaccagctcttgggagcactctctctggaattaatagagctgaaactcactcattaccgtgaagacggcaccaagccatttataaggatccacgcttatgacccaaacacctcccactgggccccactttcaacactgagggtcacacttcaacatgagatttggagaggacagacatccaaactgtatcagtgttcttgtatctgtggagcatcagaatcaccaagatggatttttgacaatttcaggttcatagctcccacctacagcgcttcctggaccgagagaaccccctccgcaggacctggtaactgtgcagagctcttcagggcttccagggagctgccatgtttgggccctgctgacctgactttgcagagtccctgctgcttctttgagggagggaggtgtgatgagaacagtgatgttgatgaatgtaaaagcacttcgcagactgcagctctccgcacatcgccatgggcaccctctgctttcattcttccattctgcgattcttcctgatttctatgctttttctagcacctcactgccctgctgccgacgcttctgagatgaaagttgatctcaatccttgtcattctgataacactccagcttcacatcttgagataattccaaggttccttttatctgacttgcagatggatttgcaaaatatatgtaattcatttatcacctaggcttgacctggttacttctaccatgaggtaactagggctctgaaactggagttactggtgcttcaggtgagctatgcctgtgcccctgtgtaacaccaaggagcggaacctgaccccaacaggcaagttcatgggaggaatatcagcttctctgtgcttcttttcttatggatttttccatggcacatatgggaagtggggatcaaatgaggtcttttctgactgatacagaattgttttcccctacaggtttttgggggcatagttccaagcacactggcaattttgcctcattccttaatgcagaggtatcatgcttttcaaaatacagaaaaacgccactgaattttactcactttgatcctttactatctgggcttttttttttttttaatagactttattttttaaagtaggtttcatttcacagcaaaaccgagtggaaggtacagaggtttcctgtacacccctgatcccacacatgcacagcctcccttgttatcagcatcccccgcaagagtggtacatttgttatcaatgaacctgccttgaaagatcattattacccagtggacatagtgtatattaaggttcactctgggtgtttattagtttccttgaatatttgaaagactcaaggaatttccttctgaaccagttttccagccaaaaggaaactggcattttttaaaaactaggacattttctctccctttatcctcttctcttttttccttcccactcccctggtaggtctgaggtcccttaaagttgaggtgagggtgggaagagacaggtggggacagcagagtcaggtgtggtggaagaagggagggcagaggaccagctcgtgttccatgtaccaggccgagaagcatattcgtgtctgtgggttcgtttgtgggttatagttccgaaagttgatataccacaaatacaactctctggaaattgaacagccagatacgaaatcaatggaaatcaaacccagtctggaattgttaatataatctgtcctcaacccagaaaaagcagtgagtgcttcagatggtacaatgtgtactggcccctggtaacctttgcgttgctggctgtgcccaggatgtttatttcttttgccttacatttataaaatggatctcttggaaacttcagtactggttttctaaacatccttttgtgattctactttgtacttgcctgaattctgaagtgatctttcttcaatagttcattcatagtcagtcatccttgatctatatatatttttttactgattcctaaaattttttggtaagtttaattcatctctcatctagtaatgactttaatagtctgttgcaaatatcggattgcttttccattgctcaaatatcagtgtgcagtacatataaaggcaattcctttgtttaccaaaggacagttcccactaggttaaatctattgctccatctggcccaggggatgggttctgttcacttagtgtttccaaatatagggcactgtgttctagacactcttgcttctagtaaggcaatgttcaaaatatcatctcaacttctagtaagtacttattagtaaaacgcagatgctctctaaccagagctcattttctccaggtcttatctttatgtacatagtatatgtacagaatcccagtgactgcaaattcctggaatatgtattatgtgtgtttatgtctctaatttgctatctctccttgtatgcttaatgttgaactttaaaaccactttttgggaattgttacaaaagctatgtttactacatactatgtgtatatatttataatacataacctaagaatgtgttgctcttgatcctttcggctgggactgttagttatcttggtctctgaatctggtttctgtgtatgtgagtatgtgtttatttgtatattttgtcccatttttggactcacagaaaattaaaaacctgcaaaccgaaactcaccgtgaaaatatttgatataggtgtttttggatgcattttaaaaataataagtattctcattatttaaacactattgtaacacttcagcaagatgcagatttaggcctgaaatcaaccactggaatatatgaagaagaactgatttatggatgttactttatagagttttattatacacagtccccaggactatatagccaatcccagtagggcttaatcaggtaccgttaaatactgggctttaggaccataatcctaaactgcagaatgacatttatctaaagtaattaccttgtgactcaaccacatttcactagtatttgctaatctccctagcatatgggatctgggaattaaaaataagcagatcaaataaattacattttatggtatccttagaggatacaatttgactttggaattgaaaatatgtttgattgcgttactttgttaattttttttacaaggaaaaattaaaagaaagaaattcttctatatgaaaatgttactgtatagctttaaaggcagtaagaataaactcgtagccatgaattaccaaactcaatgcctttttgtctgtttccagctaacacctgtgtcccctggaaggcttgggtagcaaatgtgcccacctaacagtgggaaaaatagcttctgctgggctggcaaaagcagaaagtcgtattttggaaagagtgaagaaaaatgtcaatgctgacctcacactttctcccagtttctgtccccatccccactcccctcctctcacacctgggaggaagtgagaaagttgctacagtttaggattatgaactttggaataagacaaacctgggtttgaaacctggcttgcccactaactggctaagcaaacctggctctgctgtttgacattcctgagcccctatttcttcgcctgtaaaacagggatgagagtgtatacctcaccagtttcagagataagatttataaaaggtcctaggtgaacacttctggctcagagattgacacaaagtgccataaacagctgctcagcccatggaactagcaaaaggtggtctcagtcctgagggtggggactaaaactaggtttcccgccacctccttgaggctgcagcgcattccccagcttctgccagaggaccacatatgcttcttcgtttaaaggattctcttacgatttaaaaggacctgctttatccagagtcctgtcttctttttcattcccattgatcatttgtgttttgctgagatgtttttctatactatattattcgtctttttaaaaacaaaacacagctttcattttcaattccttgttgttttgtattttatcatctttcttcgaagtcctttcagtttactgcattcttctcgcttcttaaattgaatattgagctaatttgtttccagtctttctttttcaaaaaagaaatgcatttaaacctatacacttctttctaataaacaccatagctatgctccacaagatacttttcaaaatctgttattgtttttctttagttagtcatgtaggtacatatatttttcctttggcttctggtacattgggtgttttccacttactgcatttggtcttggattgtcttccagcccacccgcctttcctgtccccattagatgattctctatttcctttatttcttctactggtgtggaagtttatataagttctattgatttttttctactttccatgctcttttaattacaattttaaaatctaccttctttttaacgttctcagtagtctgttttgtttttttttgagacagagtctccctctgtcacccaagctatagctgtagtgcagtggcaccatcttggcacactgcaacctctgcctcttgagttcaagcaattcccctgcctcagcctcccaagtagctgggattatgggcgcccgccaccacgcctggctaatttttgtatttttagtagagacggggtttcaccatgttggccaggctggtcttcaactcatgacctcaggtgatccacccacctcggcctcccaaagtgctgggactacagacgtgagccaccccgaccaggcctcagtagtctttaaaagttaatttaatgtagtcccagctactcgagaggctgaggcaggagaatggcttgaactcgggaggcagagcttgcagtgagccgagatcgcgccactgcactccagcttgggcaacagagcgagactctgtctcaggaaaaaaaaaaaaaaaattaaacatggtaaagttggattctccaaggtagatctagaatctgttattcaccattggttctggtggatgatctgaagtgaagatccgtgtagcacggaccctagccaatcaggagagaggcctgaccatcagctgagtaccctgggccaccacgtggctcacaatggctgaatgcccaccttctacgtgacatcccacatgtgagtgtgacaccctcttagtaccaaagaaaaatcttcacttttttttgtggtgaaggtctgatagtagtacattcttttattcttatatctgaaaacatctttgttttgcttaatttttgactaataacataaatggagatggaatcctatattgacatttattttccttcagaatttttgtaatgattttctagcgacgatcttaactttgtcagtaatctttttctctctgataggttggaatatatttctctggctctgtaatagtctgtagtttcatataggcaagacatgggtttctttcctgcttggcttgtaatctttctagaatccaaggattctggctgtttgtcagttctagaatctccttcagattttagctcttcaaatattgtctcttctttcgtcttcttccaggtctcctattaaagagacattggaatttatcattcttttctctatatctcctaacttttctttcatattgcctacctctacccctctgtgttatgctttgggtgatttcatcaaatcagctttttttcctcactgcttctttttcttctgtgtctactctgaagttttattgaggtttttttttggatctgctttcagaatccaaattaatttattataatttaattatgtacctctgaacttcatatgtattgttgctttcagatgatccaaaaaaacacagacccatcaggtcttttgcttgctttctgtggtgggctgtggtctgtgtgagaattgttcccctttggttatgttgatttcctttgatccctatagcccattccctctacctccctctgtcgttacaaatgtgctaatgtgcatctttctgtgttttgcacaatgcatattgttgttttgtttgcatgtgggtttcaatttacatcatcaagttgtattatacatctttcatcttcatccacactatgtttctggaactcttccatgtcacttgaaaattaaattcctgacacctaactgctgcactgtactctatggtctctatactgcacattttatgtatccccattcccagggatggattctaaaactgaccaacaaccccatcatacatcttgctgtgtccataatttattccttcctatgggttcttgttctcgctgacttcaggagtgaagccgcagaccctcacagtgagtgttacagctcataaaggtagtgtggacccaaaaagtgagtggcagcaagatttattgtgaagagcaaaagaacaaaggtaccacagtgcaaaaggggtcccacgctgggtgctgctgctggctccagtggccagcttttattctcttatttggccctgcccacatcctgctgattggtccattttacagagcactgattggtccattttacagagtgctgattggtccgttttacagagtgctgattggtctgttttacagagtgctgattggtgcgtttttacagagtgctgactggtgcatttacaatcctttagctagacacagagcgctgattggtgcatttacaatcctttagctagatgcaaaagttctccaagtccccaccctacccagaagcccaactgacttcacctcctattgctacagtgaacatccttgaacttgtccctttctgaaggtgtgtaagagtgtctctgggctattcacagaagggtttaactagatactgccggatacctctaggctgtgacggtgttagcctgcactctatttttctcagtgcatgagggttcttctgttcctatatactcaccaatccttgcaaatacctggttttctaatgtaatgcccaactttgtttttactaactctgtttttaggcttgtttccacctgaattgattctcccttagctaagagagccagatagactccatcttggctctttgactggcagccccttcctcaaggacttaacttgtgcaagctgactcccagcacatccaagaatgcaattaactgataagatactgtggcgagctgtatccgcagttcccaggatttcgtctgattgataacgcccaaagccccgagtctatcaccttgtagtagtcttaaagcccttgcacctggaactgtttactttcctgtaatcatttatccttttaactttttgcctacttaacttctgtaaaattgttctaactagacccccctcccctttctaaaccaaagtataaaagaaaatctacccccttcttcagggccgagagaattttgagcgttagccgtctctcgtcgccggctaataaaggactcttaattcatcccaaagtgtggcgttttctctgacttgcctggatacaacataatggaggccccagcaagatattaacgccactgggcgagagccagtctcgctccgggctcccccggaaggacagccggctcggaggggggcgccacctgaggaaacaattttcaggtccccaaagagtgaccgtcttccggaggagagcggatcgactaccgtgtcagtgccctaaaattcaacatctgagtcctcagcttctcaccccggggtcaggtaggtcagatttgactttgttctggttctggtaagagggaagcggcctggtcgccggctaataaaggactcttttttttttttttttaataaagcttttgagtaaataattttatattttcaaatttctccataataagggatggtgaatgaatatataatacataaataaatgaatattcatttatatatcattacatatattttgttcataatatatgaatgaatggatgaattaatttataaatttatgatatataaattcacatagaattttcactaagataccctctcgtgccctttccaatttgcatcttatttttttttttattttattgttattatacttttagggtacatgtgcatgacgtgcatgtttgttacatatgtatactcgtctcaaagtgtggcgttttctctaactcgcctgggtgcaacgctaattgttgatagatgcaaaggtataaaaagatatttcgtgatcttagccctttttatgattattagttaattctaggagttttgaaataatttatttgaaccttacgtaaaaattgcgcatttatatcttttcattgtgctcctatggggcttcctgtcttcttctgttggatttttcaggagttctatatatatattataagtattaaattttgttgattttagatgttgcaggtgtcttctcccattctgccactatcttaacttgtctctgttctcctgtgttaaacagaaactcatggtttctcttaaatgattttttgaattataatttatatacaataaaaggcactgatcattttttagcttaatatgttttgtcattggaagacacccaagttgacaccacctaaaacaagatgtagaacattcagttaactgtccccaaagaagattcccttgctcccataattatcagtgtcccagcctgcacccaacccagatgcaatcctttctgatttgaacacaaattagttttacctgttatgtaaatagaagcaagtggtatgtattcttaggtatctgatttcttcttttaaattataatacttctgaaattcacacatgttgttgctgatttcagaactttgtttcttttctaaacatttttcctattctgttgccagacttttgggctgtttccagggattgactaataggagaaaggctggtatgaatatttttgtagaagcctttttgtgaacatatgttaggatttctcttggggaaatactaagtgggatggcatgtttaactttataaaacttctaaaaggtaccacttaaactcttgccagaaatgtatgatagttcttgttgctccatattctctccaacttttcatcccaacagtattttaaattttaaccaatatagtgtgtatgagatggtattgtattattgtttaaatttgtctttatctaattactaatgatgctgttacatgtgctcattggacgtgatatgtcttcttctgggaagtgacaattcaggtcatttgcctaatttttcttgggttgccttcttactactgagttgcaagagtttttttttttaatatattttgggtatgaatcttttgtcaagtataatattttgtttttaatttgtagcctgcctacctatttattagtgatgcctttcaattagcaaatttaaaaaattgatgaagcctaattcttttatttttctctagttaattttaacataaggagttgagtcggactcaaggtttatttccctccatctatttatctgattcttacaatattatttatgaaacaggctttcatcccctgtcacctaattggctttgcaccttgatttttaaaaagagccgtatatgtgtagatctctattctattcccgtaatctaattgtctgtcttatgccaaaactacactgtcttaattatatatgtttcattcgcgtccgtgtgaagagatcaccaaacaggctttgtgtgagcaataaagctttttaatcacctgggtgcaggtgggctgagtccaaaaagagtcagcgaacagagatggggtgggactgttttataagatttgggtaggtaaaggaaaattacagtcaaaggggggttgttctctggagggccggagtgggggtcacagggtgctcagtgggggagctttttgagccaggatgagccaggagaaggaatttcacaaggtaatgtcatcagttaaggcaaggactggccattttcacttcttttgtggtggaatgtcatcagttaaggcaggaacaggccattttcacttttgtgattcttcagtaacttcaggacatctgagtgtgtatgtgaaggtcacaggggatgcgatggcttagcttgggctcagaggcctgacaatatggttgttctagaaatcaaattgtataattgttttgagatggtagtgattactaatgttttattgcagtcttaaaaatcaggtaccttagccaggtgcaggggcgggcacctgtaatcccagctacttgggaggctgaggcaggagaatcccttgaacccaggaagtggaggttgcagtgagccaagaccctgccattgcacccagcctaggcgacagagcaagtctccgtctcaaaaaaaaaaaaaaaaaaaatcaggcaccttatgtgattctcttttttgacattgtttggcttttgaaatgtattatcttgccctactgcactacctaagacttcttgaacaatgttgaatattgattagaagtgactaaaagtgatgagtgaatacctttgccttgttcctaaccctaaggggaatgtttccaataattcagtgttagatatcatgttatttgtatatcttctgtaaatgccctttatcagattgtgaaagttctcttttattcttagttttttgagtatttctcataaaagaagctgaatgttgtcaaatgctttttctacatgtattgagatagttatataatttttcttctttaatctgttaatgaaatgaattattttgactgatttttaatgttaagccaattttgtattagaaaataaacttgacatggtcatgacctgttattctttttaagtttatagcatccaattgctaatattttaatagatctttgtgtattggaccataagggatatttttcttttttcttaaacttataatgttttttgtaggtttaatatctgggtcgtgcagtctcagaaagtcatttgggaagtgttccctcctcctctattaaaaaaaaaattgtgaaggattggtaattggtattacgccttccttagatattgacatctagtcaggagttttttcttttatgtttttgttttattttatgggaaggcttctgattacaaattccatttctgtaacaggtattaggctatttagatgttctattttttcttgcatcagttgtgataagatgcgtttttaaaggaatctgttttatataagtggctgtatctttaatggcataaagttgtttatgatattcccttatttttaatatctgtagaacctggagagatgctactacttttattactgatatagattcttttcattttttcttgacaatttttctagaagtataccaattttattaaactgtcttaaacaaatttctcacattgttaattttcttttatgtgttttcattttatttctgctgtttttattatttcctttcttatattttagttgtttttcttagcttattaaaagctaaaactttttgttttacaacttattattttcaattcaaatagggaattaaagctatgaatctccctctatgcaccaccttcactgcctttcacattttgatatgttgtgttttcattttcattcaattcaaaatatattttatttttccctgtggtttttctataggtcatcatctgtttagaaacatgttgtttaattttcaaatatttgagtagttttaaagctatttattttcatttatttcaagtttatttatttatttatttgagacagagtcttgctctgtcgcccaggctggagtgcagtggcgccatctcagctcactgcaagctccacctcccgggttcacgccattctcctgcctcagcctcctgagtagctgggactacagtcacccgccaccgcgcccggctaatttttttgtatttttagtagagacggggtttcaatgtgttagccaggatggtctcgatctcctgacctcatgatctgcccgcctcggcctctcaaagtgctgggatcgattttaatattattgttttcagctatcatactttatatgaattttatcattatgatttgctggggaatttttcatgttgcagaatgtgattcatcttagcaagtgtttcatgtgatcttctcaagaaattgtagtgtatagttgttgagtggagtattctattagagataattatgtaaattttgttgacagtattaaaatctcctatgttctttgatttttggtctacttgttttatcagttataatgagaggcatattaaaatcttccatggtgaatgtgagcttttcaaaagcaacattcttcctttagtgctgtcaagttttgtatcatgcattttgaatctctttattaggttcatacacatttaagataattacttcttcttgatggagtgactcttagcattagaatatactcctttttctctctgggttactatttgtcttgaattgtactcggtcagatataaacatagccgtcgagatttatgatgcatagtggttggatagtatgtcagttttcaacattttattttcaaatatctatctctttatgctctaagtgtttcttgtaaaagtcatttatttgaatcttatttttaattagtatgtaagtggtatttcatttatatttaatgtaattatcaatacaattgtatttaagtattttaccagtatttgtttctctttcttatttcctgccttattttgcataatccagcaattaactttttaaatatactttgtgttattttttaggagtttgctagaaattacagtatgtatacttaactatcatagtctaattttcaattatactaaactttaaaaaaatctaagactatcacaattatataattctattctctcattctttgtattcttttgtttcactgtattctataaaacttataacacattgctactggttgtgctgaaatgcatatatatgtacacacaaacacacacacacacacacacacacacacacacccacacacacacatgttgagtatcccttatcccaagtgcttggtaccagaaatgttttagatttcagatcttttaggatttgaatttgcatttgcattatatacttagtagttgaacatccctaatgaaatgtgcaattctccaatgaggatttctttggaatgccatgttggatctcaaaaagcttcagattttgggccaggtgcagtggctcacacctgtaaacccagcactttgggaggctgaggtgggcagatcacctgaggtcaggagtttgagaccagcctggccaacatggcaaaacctcatctctactaaaatgggaatatttcagattttggatatttggactggggatgctcaacctttaatatgtgcttaatatattatgcaacatgtatgtctgtatacaaacaaacacacatgtatattaaatataataagtaggtcctttatttttacctatatgttatactacctatgttttcattctttcctgcagatttgagcttctatcatgtatgatattctttcagcctgcatttctttaagcatttcttggagcacaggttttttggctaaaaaaatctctgagttcttctctagctgaaaatgtctttacttagctttcattttcttaaactgatacatattagatgtccatatcttcaggatacatgtgattttttgaagcattcatatcaagtgtaaagatcaaatcaaggtaattgagatatctatcaccttgaatattcatattttatttatgagaagaatatttgaattgctctcttctatagcttttatttttttatttatactttgactaaatgtagaattcaatgtagaattctatgttgacagttttttttcagcattttgaattttttttccattgtgaggaactcatccatcattcttttcatacttcccctaaatataacatgggctattttttcttgctacttttaagatttcttttcaatttttttttcttttaaggttcacctctgatgtacctaggtgtgattttgaaataactttttaaaatcttatgttgtggtttgctaatcttcttgggtatgtaccttgctgtatttccttaacttaaaaaatattggctattgtctcttaaaatattttttctcctgtatctctcttcttcttctgggattccaattgtttatattgattgatatttttacacaggtcttggatgctttgttttatttttttcatgtttaatttctttgtgttttattttagatattgtctattggcctgcctttgattcttttctcttctatgtccagtctgctattaagcccatcaaatgaattcttcctacctagtatcatacagttacgtcctgatagttccatctgagttttgctttcaccgtttgcttcccatgctgtagttcttcacctgttcacacgtgtcagtattttcctctagagccttcatcgcagctacaaagttcctgagtgataaatcaaacatctgggccatttccatatttgtttctgttaatgagttatcttttaaacatgggccttgttttgttgtttctttgtgtgtcttgtgactttctgttttatgctaaacattgtgtgcagattgaagtaaggaatgtttaccttgcccttgcaggaaggacatgctccttctgtccttctgtcgggctggtgatgtggggctgagtcaatctgacatgtggctgggctgtgctgggctctgttgcagagttaggatcctgagctagattctctttaccttgggttcacatggtgtgaaggtggggtcagcactttgccttcagaagggcttgggatctgagcaccagccagactctttgaatctttgtgctttactgaccagtaaccagctttccaaactgtgggagatctctttctgctttacagcttgcctgccagctctttgagtttctggggcattctctttgctctctagacctgttcttgactttctgtacctggggagatctctttttgcatcaatggactgccctcagcctttgaaggccactgcagggtacttggggaatgcagagatccacctcagttctcctgcactcatcccagcttttggcattcattttgttcactacatttgtccttgcttccttacgttcataccacaaatttttttttctgctgtttgctaattctatgttctatatattatttttatattttaaatttatattttgctctcttgacatctgaaatccagtgtgaacacacaaaaaataagtaggaaaaactccaagtttcataaaccttacctaaagaagtcatttctaatttattcataattgaagctcctgaaaggtctgatacagctctggtacaagggaggtatgtcagtcagggtccaccacaggcacagaaccagtaagttatataggggacagatagaaatctgaagaggaagcgcttgaagtgtttttaggaattggcaattgctgtagcaactatggggcggggctgagagtgtctgaaatccgtagggcaggctgtcagaaagggctggctagaactcccaggcaggagctgatgccgcagttcacaggagcaattttcttctttctcagggaagcttcagttttcctcttaaatcttttcgactgattgaatgagggccacgtaaacgatcaaagacaatctcctttacttaaagtaaattgattacagctgttaaccacacctacacaataaccttcatagcaacacctagataagggtttcatcaaataactggaaactatagcctgacccagttgatacataaaactgtttatcacaagagtaagggtctattccacagtgtggcacagtatgtgttaaagaataaactgtaaggaagaaaataaatggaagcaagaaaatgaaagggctgtgaatcctgacatcatccaacagcaaggcaccctggggccagctctcctgcacagtgggtaggtctgtgtccagttgagggaccctcctgcacccagtgactctcccttcttgtaagccccaaagaaatgctactaggcagggggataaacagcctatctgggattaggcatcagctgttactggagttgtctgggacagccagctgcccagcacctggagatgctgaggcccatgggaatatgtgggccctgctgccaagggaagaggcctcctgctacagccctcgtggtaacagaaaggaggacccccttcttccagttggctcattgtctagcctgccctgagtgagctcctggggcctctctcacatcattctgcccactgcacaaaattgtctgcttatagggcagacattaaaatgctggtattttattctcaaagtgtaagattattatttatttttattttgcctttctacccatctgtatttactaaaacttttactatgtgactatattaattctataataaaaatcaatataacttccagcattttaaataaaaatggagacaagtttatattccccgaggaagaaaatatcattttaatattttgtattttccataagtctccacatataaataccttaagcatctccttgaatgtacagcctggagtgtttctgtgcctgcagtggtctgtgggaaggacaaaaaacaccctaagacctgggagaactcctttttggaggcaatggggtagcttgtataatcagaatattggaaatgattaatccaaattcattgtcttttttcaactagaccagcaatcttaaagaaaaaaaatatatatatttgaaccatactaacacactgtgctttaataaggatagacaagtaactttgctaatatgctctctttctccttgcttcttgggaaactgtcagaatggtataaaatttagataagatgttgtgacttagaaaagaatttgatacaggaagaagggggtggtacacatgcattccccattcattgctaaatgcttcaatcaaacatagtttacgtatcagaaatggaaagaagaagagacaggaaaacatactgattatctacactatcaagaacactagaggcggaggttgcagtgagcggagatcgcgccactgcactcctgcctgggcaatagaatgagagtcagtctcaaaaaaaaaaccaaacaaaaaaacactagatcaagagtggtagttttgtagagaataaattcttatagaaaggaacaaaatatcctaaagactgaattttaatgtttttgaaactagtgtttctgataattttcaaatccatgccatttaacgaggaataggcagagtgcttatgttatgcctgatgctaatctaagtttgggaatgctaacacattagcaaacaaaacatcccagcccttgaccttgtggagctggcattcccgtgaggggagacagatgttgggcctgatgagtaagtccattgtagaatatgttcagagtgataagtagggggaatgagatgaggaggggcatttggggcgtatggataattatagagacagatgtttgtctgtgttccttgaagtggggcttctttggtttagtgcatttactagtggataactaataaaaaacggctgcagtcccttgagccttatttcacttggatgtccattgtcttctagagcaaattgttattatttggtgtggagaggagatgcggaaacgcagagctctggctgtgtcctgagcactaaaccaggcactttcatttccatttccttcgtcttagcaaggaagacaaggaggcattaagcagctagctaccttgcacaaaggccgttcaattaatgggtggtggaagaccgggaggccccaaagccggggccaactatttgctaggcacagtaagttcagtgtctgaaaccaggatacgttttggagcccatgacaattgttttaatttcttttaaaatcagaaggaaaaacatatgtaatccagcctgattgtatttgtctttatacttacagagtcataaaatgtaacactgatttttggggagggaggacccatgagcatcttaacatggccctgcttatgtgtctttaataattctgttgcctacaccccttctgcttgttgtttcttggcatttctccttcgcactgaaaggatgcttgtgcttacggacttgggtcatcttcaacctgtgtccatccccactttcctgtgtctcacagagggccaatgaagccaaggctgttgtcagcaagtatgatgctcagcatttggtagggtgcaacacatatttgttcaatgagtgaatgaatgagcaaatacatgaatacatgagtggaggaacctggcaatagcagtagtggtgggtggggggatatttacttctcttcctagcagactttttttcaaagaaatgtggcatcagcccactgaatgttccagccaatgaaattattttcaaagcattctgtgtcacaaagcccatatggctctgaactaaagggagaattagaaataatctgaaactcagttaaagataagtttgctaaatccagtgcatgatgaattcaaattacttttgcataatgaataatgtgttgggtggtgagtagcggtgtgaaaagctaaattgtgataaacgcaagcttgcaagagtcaatgaatgtctggagagtcttaaactacttaggtgcagttgaaggtcaaaagttcagcaatgtctggcagagtagatcacatgggattctcttgattatgttagtaagattttatgatattactttcagtgtcttgtcttctctggatgatggctggtaagcatgtttcaggccatggcattcttgttatgatgtctccagagagactccccagcatcactagccatctagggtggccgtttctgagcgtcaacagtgccaaagcttctgccctgtctcccaaagcacatgcttacagcaggctaaggagaaaaccctgaaacatgaaatgtaggacaataataatatatgtgaaagaggaaaaaggatgacatcttaatgactgatttagcagagagggtttacagagtttggcttacgtctagacttaaacccttttggtttgagaagtcatgttttagttatctttatgtgccgtttttcatgaagcttctcttggctggggtgtaaagttgatataaaagggtacatgttgttggttcatgcgttcatgctgggggacctgcatgtgtggaaatgacaggagtgacaagagtccaattttacaaaataaactgggactctgaagttttggaggcagacatttgtgattccttctgtgtagttgaaagtgattcacctggcggtattttccctctgttgaagttgaatccccctttccatgtgatgttaaggatgcatgtggacaggcaatatggcccttcttcagataagacactctgggctgctggctgcggttctgggacatcttgaagcccccgaggcactgagtgtgaacatgtgggtgctgatgataattcagaagctatttagaaggtagggacagcaatggaattttgtggaaattaattccaatgtaagtgtgatatgtcacttatccaagggtgttccttatgtgtgacctatttctatgacatcagtggcatgaggcttctctgtgaacatattaatatcttggcattctttggttgagattagcatcagtcagaagctgtggataggctagagtcagctcaaaaacccctgatcacctaccctgacccctgagagtttattacgtagtcacagatggcttctctgttctataagagtagaacttcctcttcatggtcttcttcgagctacagtgtctctaatttccctaaatggctgctcaactgtcaagagatgtaagccctattagccgcattggccattcagctatagacacccagtagccatggtgggtagcagagcaggtctggctggagaggagaagccagtacctcggctactggaaggcagcaggcatacaaaggctgcacttcttggctcctgtcttatgtctttactttgttgtcttcacaacatggccttaaagtattttggaaatggcaccgtgttgggtcatgtgtgtcaggggagcagtatcctcccctccacctctgcccatcccacctgggcctcttcccttccaatctccaggtgctcaccttggaggcacagggagcaactaggtctgtacagcacaccttgctggcacaccagttctccttattgccaagcagcttctcaccctaattaggtattaaaataaacttgcatttgttatggaaagaatgtggctttgtgtgtttttaaggcaagacacaaaattttaggaaattttatttcttgactggcagaataggacacagaagggtctagccttggcaggttcccgtttcacgtgctcattccatttagtcttgaaaacaatcccatgagtagagacagacctagagaaaggaacaaagtggctcaaagtgacctttttgtaggaggcagggttggcaggatccaggcgagatacttggtgctgtcctcagccctaagtccatgccccaaaacaggtcaaaggaaggccagaagtattgatagagaagtagaggaaggaggagggtggtgggaggtcaacgctgagtaaataaagcaacactgcctcttccctctagcttctttgtgtgcatagtcagaacaatttctccaaatttactctgaagattagttactggcatccgtgaagaacttggaagggacaaacgtaccattgttttcatttttgttcctcacaggaaaattcatactctcaaaatcattgttttttcccctgcagtggtctgttttgtagagttccctaaccactttgtttccagtggtaactgtgtactttcctctgacacaagattttaaggaaaagaaactaccaaagatgttttatgttgatttctttttccatatttaggactgctgaccaagcacatttattgtggttatcattaaatgtttgacatttacaaacagcagggcacagagtacgcatctctcagatgggcgggaagcctgagaaccaagggctttcagccgcgtgccttttgcatggctggccttgctcacagctctgctctcactctgcctcccttctcccctgaaatgtgctttttcataggaggctctttctgttttggttttcctgtttttatggctctgcttctaaacatataactatatataaacatataaacatatataaacatataaacatatataaacatataactatatatacacatataactatatataaacatataaacatatatataaacatacaaacatatataaacatataactatatataaacatataaacatatataaacataactatatacacacatataactatatataaacatataaacatatatataaacaaacataaacatataactatatatacacatataactatatataaacatgtaaacatatatataacatataaacatataaacatataactatatataaacatataaacatatataaacatataactataaacaaatagatatattttgttttacaaatttttattttgttttatacatatataaacaaatatatatatatatttcaaaatatagatagtattatcattgatctggtggaactctgagaatttctggattgaagttctcagagttccaccagatcaatgataatactacctgtatttcaaaatataggtagtatttctgctgcttctctatgatgtgttagtagtagatctcttgatctcaggtgacttcaagctgggagacaaactatctttgtttagcaaggacagagaagttaaccagttgcatgactttcagtaaaaaaaatgagagagtcctggacaaaccaagacagttggttgacctgtgagtggtttcagtgtgcaagaacacactggcagttttgacattttgagatgtggtggctctcctagataataaactgtcttccacttctgtgtaagcttttcttagggataactcaccctgcttcagcaaatccgggcgattgtctctatcagccaaattctgcacatgtagcctctgaatctaaaataaaaattgaaataaaaagaaaaatataagatgctttgtttttgcgtctctctctcctagccgttgacttttagtgcatgtcgtgcaggcgacagacgtattgctgccctttctgtctctggtcctttttctagggcaggatccaagtagtttttgtgagcattgcagccagggatcatttcctctttcccttttagggccacaatagtgacctccagcagcactgggtactgaaatacagggctttggctttcccaggctcatacacatagcagagcgtctggtttaaggtctgtataattttgtgtaattatattcaattgctcactcaatctctgatcactttctaatgagctgttattttcagaggtagtagaaaaatcagttcaggaagagatgatgatgtgagagaaataaatagcaaatgactagtgaggagaaattacacagtaaacatgatgctgagctttctctgagtgagtggtgtgtctagggaggtgtattatgaagtacattgctatgaagaacggcctgagactgggtaatttataaagaaaagaggttaattagctcacagttccacatggctagggaggccccaggaaacttaacaatcatggcggaaggggaggcaggcacatcttacatggcctgagagagaaggtgagagagcatgtgagagtctgggaaaaactaacatttataaaaccatcagatctcgtgagaattcactcactatcatgagaaccgcatgggggaaactactgcattgatccagtcacctcccaccagctctatccctcaacacctggggattacagtcaagatgagatttaggtggggacacaaagcctaaccatatcaggaggggtgtgttagttgagcagacacagaaaagcaaaacatttgagcccaagagtggaacccatcccttataaggagagaccacgatgtggggaaagtcagtgaaatggacatatggctaagtttgtttagtgtttgaaaatgtcaccgaagtcactttttaataatgaaaaatatgtggattgaagagtttaaaagagaagtatgcccagatgttattttaaaaattggagtgtatacaaagggcccccaaatctaggctgccttagtatttttgcccctagctttgttttcccttaagtgatgtcaggaactgccagtgttggcctctgcatctccaaaactgaagacagcttagttcactcggtctcgtcattattgtttcatgaaagcatgtcgttgggagatctgggctcagacctaagattgaaacaaaaaaggaaagagaaagataagaaaaccgtctcattttcaaaaaccttcacaaaccccacgttttattaaaatataaaccatttgaagaaaagccagaggaaaatagaggaaatggggtatcactgaatgaagcagaagctaaaggatgatcatataaattgtctcaaatagcaggtcaggaaccagtggcctgtcaccatgaaaacaaagttaggggaaatagacaaatgaaaacaagtgagtttacattattcctaagaactttctgccggtgagaaaataatggaacgacgtgtagtcagcatacacacaggaatctatattttgtaggttatatttcaaaggattcatgtaccctgaaaagaactgttgactgtagggtaagttaacaccagggggtgctgggtgcaggcacattgaatctgaactactgggttgccattttagactgttaccatcatcactgttaccacacctgtagtttaggtcattagataggtgtggaaatgaagcctggctccttatcaatcgaaagcctatgctcttaccaaatacactatgctatttaatattggtaatattagtgaaatttagccgtttcagagttttccttctttccccaaagcatcatttgtcaatgtttgttaacatacgacacttaatgtaatcctcataaacaaagtggacaccctcaagttgttttctgggatttttacataagcatatggtccttgagcaatgatggtttgactttactatgacaatatttggctttaccgtggtgtgaaagtgatatgcattcagtagaaaccatacttcagatttcaaactagatctttacccgggctagcaatatgtggttccatactctcttttgatgctgggcagaggcagcaagctgcaatccccagtcagctacactgtcacgggggcaaacaaccggtactctacaatgcattgtgttgccagctttttttggatgtgattttgcccaactgtaggctaatgtgagtgttctgagcacatttcaagtaggctaggctaagctatgatgttcagtatgttagaggtattaaatgccttttgacttgtgatattttcaacttacaatgagtttctccagacataatcccactgtaagtcgaggagtcgctgtattaacaacgggtagactgaaaacaccgatgtgcaaacctggttcagtacggatggggtggacatcggcatcagggttcttgtgaatattccccgggaacatggggaacgtggtgttgtgaaatctagagctggccaggaatttccggatccttacctccagctttccaccccacacagggggtccccctggagccacctgcctacctgactgcttatcttccagcctctgtctgagcttctctaggtaactcctacatccagggcaactaatttcctggagcaacagaagagccttccttgtattgagacaacatgcatggtctccctgcaaatgctgcctctctgctcctacatcttcacattttagtgtagaaagagcaatcgtgggtgagaatttaagcacaagtgtttagttcaaaagacagaaaattggccacgcatggtggctcaagcctataatcccagcactttgggaggccaaggcgggcggatcacgaggtcaggagatcgagaccatcctggctaacacggtgaaaccccgtctctactaaaaatacaaaaaattagccgggcatggtagttgggcgcctgtagccccagctactcgggaggctgaggcaggagaatggcgtgaactcgggaggcggagcttgcagtgagccgagatcgcgccactgcactccagcctgggagacagagcgagactccatctcaaagaaaaaaaaaaaaaaaaaaaagacagaaaattttaaaagcatcaaaacagccgttacagagagggaaaaaaagttcttaagtatcttagaactgcttcatttcaatagatgttgcaataagctgacttctatatgacttataggtcccgaatcattgatatttatgtttgcaaatttgtgtgttttgtgtaaatgagatcccagaactacaacataaacttctaatgaactctgtttctatacctatgtggatcctgagaggtgctcaaatatgagaggctgtttctcttaacctcctattctgcttaaaatcatttgtctttacttgtacttttttttttttttttttgagacggggtctcgctcttttcgcccgggccagagtgcagtggtgcgatctcagcgcactgcaagctccaccccccgggtttacgctattcttctgcctcagcctccccagtagctgggactacaggcgcccgccaccgcgcccggctaattttttgtatttttagtagagacggggtttcaccgtgttgaccaggatggtctcaatctcctgccctcgtgatcctcccgcctcagcctcccaaaggtctgggattacaggcttgagccaccgtgcccggcctactttaactggagaattcattcttccaaatgtgctcattcatggttttattttattttattgcattggattgtatcattgcatctcctacctgtgcattttaagagtttccacttcaaactttgtttcattatgaggtaaaccttaaaaaataaagcctgttttctggagtgccacagacattttgtcagaagaaaatgtgactgtcctttaatcgggcactgttttatgcacataatacaaatgatttctgcatgcttatcagatctacttgtgggcttataaattcacttcatcctggcatacgtagtgaaggacattcctctgtgccctgtcaagaataatcaagcttttaaaatcaattccagtggtgataaaaataacgaggatggtttgtgaaaagggacaaaaacttggtaaaaataacattgaaggatttacaatatacagagagaaagtgaaccatctctttgaaaataagtgtaaaaaagaaaagtgtatctaatatttttattgatgcataagctatgaagagaactatcaatgtttctgtcttgctctaaatgagatatgactggtgggatcccagatcatttgattatccgtttgcagactgctctgtttatttaaaacataattcactctctcattctatagatggacttactagataggagtctgtgctttataagtgaaattaacttagataatttttttttttttctttttgagatggagtcttgctctgtcgcccaggctggagtgcagtggtgcgatcttggctcactgcaagctccgcctcccaggttcatgccattctcctgcctcagcctgctgagtagctgggactacaggtgcccgccgccatgcccagctaatttttttgtattttttagtagagacggggtttcaccgtgttaaccaggatggtctcgatctcctgacctcgtaatctgcccatctcggcctctagatcattttaatgacaactgataaagagataatcaaatgataacctgtttttctcagtgatagaaatatgtgatggaaagtatctgagactaatgaaagacatggaaactaatttaccgatgatccttggatactagttatggaagtatacttatattatctatgcaaatatacaaggtcttttgaaaaccttttacatgcccaacgccaaatatattaagtgaagctacacaataagatactgtaggatcagtaaacaggtattgctaacgtttgtagcaaaatcctgttgatccacattgttgggtctttcttggtatggtctagtgagatatcagtgcgtgtgtatatatgtatcagtgcattttagttcattttgtgttgctataacataatactggaggctgacaaattaagaagaggtgtttgcttggctcacaattctgatggctggaaagtttaagattgagcatctgcatccagtgagggcctcaggttgcttccactcatgacaaaaagcagaagagaagtgcgcatgtacagggagattacatggtgaaaaaaggaagcagctgggcatggtggctcacgcctgtcatctcaacactttgggaagacgaggtgggcagatcacgaggtcaggagatcgagaccatcttggtctctactaaaaatacaaaaaattagccgggcccggtgttgggcgcctgtagtcccagctacttgggaggctgaggcaggagaatggcatgaacccgggaggcagagcttgcagtgagctgagatcgcaccactgcactccagcctgggggacagagtgagactccgtctaaaaaagaaaaaaagaagcaagagacaaaagccaaataagccagactctttttaacaacatactctctcaggaattaattcccgagagaaggggaatgcacacctgagggagggcattaatctattcatgaagtattttaccccgtaaccagaaaaacttccacttggccccacctcccaacactgccacactggggataaaattttagtatgggttttggcagggacaaaccacatccacaccatagcagtaaatattgatatacagttgacccttcaacaacatgggtttgaaccgtgcaggtccacttacatgtggatatttttcagtaaaacttacactgggtgtgcctgcctctcctgcctccccttccaccttctccacctctcccacctctgccaccccagagacagcaagaccaacccctcctcttcctcagcctactcaatgagaagatgatgaggatggagaactttgtgatgatccacctccatttaatgaatagtgctatgatatggatatttattcccttcaaacctcatgttgagatttgacccctgatgttggaggtggggcctagtaggaggtattgcgtcatgggggtggatccatcataaataggttaatgccatccctcaggggtgagtgagttctcactctgtgagctccctccagagctgatatttaaaaagattctggtacctcccctctctctctctgacttcctctgtctccatgtgatcttcacacagttggttcccctttgccttccaccatgagtggaagctgtctggggttttcaccagatgcctaatcttgaaccttccagctatcagaattgtgagccaaataaaccttttttctttatgaattattacccagacctctgtatactgtcatagcaatacaaaatagactaagacatatagtagtatattttctcttccttacaattttcttaataacgtttttttctctagcttgctttattgtaagaacactgtatttaatacagataacatacaaaatatgtgttaattgcctgtttttgttatcagtaaggcttccagtcaatagcaaactattagtagttaagttttgagggagtcaaaatttatacatatatttttaactgtgtggggactggacactgtggctttgttcaagagtaaactaaatacatagaatctcatcttctgaatattataaacattattagacgtgtctttcctcaaaggtgattattctatatagtgatttggtttggaggtagaaaaagtgcagagaaaatttaagcaaatattaaacatcactttttcttctatacactctatttttcttactgacagaatttttctggaacatttaacagtatcttctaacaggtacctctctcacccaacttgtcctcaagtaatccccctacctcagttgagctgtatatggtggctcacacacctgtaatcccagcactttgggaggccgaggaagggggattacttaaggataagacttcaagaccagtcaggacaacatagcaagaccccatcgctgcaaaaaattaaaaaaaatattagccaagcatggtggtggacacctgtagtgccagctactcagaaggctaaggcaagttgatcacttgggagcagaaatttgaggttatagtgagctatgattgcactaatgaactccagcctgggtgacagaatcagatgctgtgtcttaaaaaacaaacaacaacaaaaaacgttggtttgaaatttgacaaaatgttctgcattcacatttagaataaacgttttatatgaggaagttaatatgtcattttctataattaaatacaatataatgtgggtttaaaatttcattctgattcttattttggcatcattaaatatcattactcgatcttgatatttagaaggtttcagaagccaattactagtgcctcaaaaactcagtactgtggaaatgacatatcattgggttctggtaatgaggaatgactatttttctttggatgttactatcaaaacatttttataggcatctggaaaatatctgcctgattaaagagctgtgttttaaatgctcaagatcacgtgtgcttttttcttccctgtgttccccaagcaaatggaatgccatctggattctagatttggctttctcatgtaatggatgtgagaccctgagctagttacttaacatcatcaggctttctggaaagtgaggataggaatgcctgaatattgaatttaaaatattcaagttaatcatgtataaactataaagatttttgaaatataaaatatgcatcatttcattcactcactcactcattcttttatttgttaattcatccaccatttactgaatgccttctgtgcactaggtactgggcttggtgctacctactggaaaattaataaaacattgtctttaaggggctcacaatgtaatgggggaaatcaccaagaaaataaacaatttcaataccatgtgtcaagtgttaaattccagtacaacatgttggtggttacaaaaacgtaaaaacaaaaatgaaatattatgggagcagagattacacttagtatcctccagaaggttaccaaaatccattttatattttacatatagtttgttctgtcatcttctaagaatacctaaaaataggaattacctctataattttaaaaaataatttagtgcaatacagcataggaggagagtatgtctccctctatgtgagtggataaccgtctctgtaatatatacttttctgagatttgttactcatattctttactcagtactatattcagtacacaatggaattcctgttactgttgactagatgactgtcgaaattggctcatttccccaaaattgtccacaaggtgaaggacttgaggggtccctgaaaggctaggtccacagaagaactttccccatggtactggccaggggaaaacattcctagtcagagacaagtatttccaggatttaaactatctttccatttttgtaagaatgatagctgccctttcccctggatcttgcacctaagtaagacttagcagaagcagtctaattttattgtttgcagttatgttctaaaatgtttttaattcgtttaatccaacaatttgtcgcattaaaaaaaaaaaaaaaaactaacaatcaaaacaaacagccaggcatggtgatgcatgcctgtagtcccagctactggctactaaggacactgaggcaggaggattgtttaagcccaggagtttgaggttgtagtaagcgttatgacatctgtaaatagccactgcattccagcctggacatctagcatgaccctgtcttaaacaatacctctacaaatgacaacaatgacaagcaccctgattcaagatctgggattttttgtttcctcctccgcttggctttgctctgaggaggataagtcacgtaacctgttgggcctcagttttgtcatatgataaatgagaaaatggaactaggtgatctttcatgaaccttttatttttaacagtcttgttttagtgatcctatgactctgtcacagaatgttaaaaaaaataattcagaagaaaaatttacaggttgaaatggatttgagaattgaagcatgaattgctggcaggtgtttgcaatatacttttgggtgcaaacggatgtgttatcttgggaatgaagagtgagaagcatttagatatcacagttgttggctagaagaggaaggattggttaaaaaattaaaggtatatttggttaatgatatatatgtaaaaatcttatttgtttgcaaagagttagacacatctgaattttcttacattatacattgtaatgcaggggccttcttgcagggccttgggatgtgtcctgtacacaaataactgatacctcctgaaaccttgcatcaggggaatcctggtggatttccacattatcaccacaggcctttcaatataaaatgctgatttgaatgacatactgtcattgagttgatctctaaaagttgctggaaattttcagaagaacttgatcctcagatactacatatgccctttccaaggcataaaaggtaagtccagtggtactttcataaaagcactgcttaaatatataaacaaaaacattttgtggagttctacaatctagaaagaaatgtgacttgtgctgtttcttcttttatttttaaaatccaccaatagaaactgtccctaagaggctttgtcctttaatcctagctgattgttaaacggtttgttattaatatcttacaattcagtgcagatggttttgagcagtgatcagatgaacaaagatgcttagtgatggttcaatttccgggttggatttgcatcctaatcttagtcttaaaaaaattagaaagctgtttccacatgagctgtataatgttttacttttttactacaattgctgtaatacttcagtccttaagcatagaaaataatgcccattattatattgggtgaaatgaaagctttttaagtgtaaaacatgtaattgtagtctcaaaactatttatgtggcatcaattatggtgaaattagttcatgaaggtaggtgaaaatacataaacattgtgtatatgctaattcatctagataagaattttcatgtagatttggtcagctgtgttagatttaaatgtagtttcagatctggttcagatggaaagtagatgaagctgccaacctttggcagcagcacacaggtggaatagctgagatagaataggtgattggtgaagaagatagaaacatttctaacacatagaagatttcaggacagtgagtgtggcacattctagatgtttcccacactgcagcaatgggagatatacagatcttcctcagtaaacccctatttctagactacgtgagtttccagttgaatcagatttgagaaatgcagtgtgctaaaggcagctcttcttaactccctctgtgaacccaaggaatctgtctcattcattggaagggtctaggaagggaagagaactctttttttttttgagacgaagtgtcactctgttgcccaagctggagtatagtggtgtgatcttggctcactgcaacctccaatgcccaggttcaagcaattcttctgcctcagcctcctgagtagctgggactacaggcacacgccaccatgcctggctaatttttgtatttttagtagagacggggtttcactatgttggccaggctggtcttgaacccctgacctcatgatccgcccacctcggcctcccaaagtgctgggattacaggtgtgagccaccatgcccagctggaaatagaactcttacaatttttctgagtttatctctttacatcagctgcctccttactgtaaaccaaaaaatacaagtctaagccccccagctgactgaatggacacaccctcttggccaaagggacccaaggaaacctgaaaaggtagttcaggccatgacaggaacagaggccatcagacatgtctcattatacactctgccttttggagtttagacacgactgagcagcattaacattaaaatagagatcctaagatggacagaaagattcttcatagcaataagataccaaattccaacctaactttagtataatatcacataacagataaagaaggaaatcaaaatattttaccccaaaatatctttccttgccatattttggaaatggttctgcaaagctgtcttttgtgggggaaattttgcacctgtaaggaatccctattaacataactagatctttcatcttccaggccctcccaatcctgaagagattaacagagagtctagcaccttttaaaagtctgaatgggaaacatttgctatctattgtctctaagggcagccacctatgagacttcatctacataataagaacctcagtctccacaaccccttatcttaatccagacagtttctttctactgattccaggtctttagataataattggttggaataattgacaattccaaccaattgtcaatcagaaactctttgaatccacctataacctgtgagcaacacccccaaccacttcaagatgtcctgcctttctggactgaaccaatgtatacctcgcatgtattgattgatgtcttatgtttccctaagacgtgtaaaaccaagctgtaacccaaccacctgcagctcatgtactcaggacttcttgaggctatgcctcaggccatggtcattggtatttggctcagaataaacctctttaaatatttcagtttggcttttttcattaacactacactttttaagtttgacctaaaggtttctctgtacatagtgaactgtcatctaactggacgtgtaaagggactgtaatctacactgtaacaagtagctgagtctcagccaatcacagcatcccagtttcagccaatcacttgcatccaactattcaaactgagctcaaataagcctgtaagcagccctgctgtttctgtgcctctcgtcccttttgtctacctcactttcctttttctgtccataaatgttatcccaaccatgtgacagtccctcagttactctgaacatattatggttctggaggctgcccaattctcaaatcattctttgctcaattaaactctgttaaatttgtctaaagtttttcttttaatagctactactactctagagaaatatccacaaagacgtaatgtgtttgttcggaataccttgttgaatggaaagaagggtctgtcctaagggacaattgcaaggattgagacacttggtggcaattttgaggaaaaagcaatttttttttgagatggattcttgctctgtcactcattctggagtgcaatggcgtgatctcggctcactgcagcccctgcctcccaggttccagtgattctcctgcctcagcctcctgggtagctgggattacaggcgcgtgccaccatgcctgagtaatttttgtatttttagtagagacgggattttgccatgttggccaggatggtctcaaacttctgacctcaggtgatccgcccacctccgcctcccaaagtgctaggattacaggcatgagccactgcgcccgactagtaaaatatttttgagtagatggctaaacagcagaaagccctgggaggcaggacggcccagagaaaggatattggttgagctgagtgtcaggcctggggctcggtgttggtgtggatctgggatccagataccaatgactagctgggtgatatcggacatttcctataggtaggactagtattttggtagggttcttttcatttgtaaataacgtcaagaactcaaaataccaagcgtagggcttgatgctccatggatcctccataaagcaagactctttgcttagcttttcattatttcattcatttcagcatttatgtcagtgtgtaaaggatacagcaacctgttgacttagccagcacattttctcagcttagatactggtagttaacagtattatttatctcgtcttgcatgatgtacctctaagaggtttgttcatcaccaccatttcaccacagcccttctccctgttagcttagctggggtttccaaacgtcaatataacagattaaatttctttgttaaatatgaaggtgagtgagctgaagtatgacttgtcccaaaatgtaacaccttatgagacaggcctagaacctaggtcttccataccctttcatgctgcctgagtatctcagtgtggttggcagcctattaaaacacagacataactgattcaactcagggtcacaaatgtacatatcagggaactttgttttatttcgtttggtcatatggatgctgagagaaggtagtgtaaggaccactgcttaccgttctcagctgttctcttcctaagcgcaagtagtgggaccctcacagccctggatgcattgttgtttttttttatctcgaagtaaatgactgaagaatcagcaggagttttccagaatgaaaatgtaataccttggtctgtttggaactcagtcaacaccttaggaatgttctgccaagcttgtttatgttacaaattaaatgtatgtatctttaatatttttgttgttggtattctctcaaaacaagaagataaatgacatttttaatgttttttttgagacagggtcacactgtgttgcccaagctgaagtgccatggtgcaatctcggctcccaggctcaggtgatcctcacgcctcagcctccagagtagctgggacctcgggcgcacaccaccacacccagttaattttttgtatttttggtagagatggggtttcaccatgttgctcaggctggtctcgaactcctgagcttaagtggtttgcccatcttggtctcccaaaggctgggattacaggcatgagccaccgtgcccggccttgttttaccctattttgattcttccatggcttttggaaaatgcactagatttttaattctttgggccactctcagataaaatatcgctgtgtactactattgacatgttaatttgtcttctaacggacaattatatatcccaaagtcatgcctacctaatggtactttaaaaggactaatttgatgatcactgttgaggatgtagaaaggctgtgaccctggcctttcaaacacattctattcaattttgcaaattgagaaggaaagtaagaggagaaagaaaaaaactgctgtaataaaattggaaattgtttcaggaaattgcacgtgctattgagatctttctctgataatttagaaaaggaaatacaaattctattatatattttatattgtacatatatatatttttttttttactggtttattttcagttgaagattaattacatccaggattgtaaattgctcacgggtcattaccagtcacctactgtcttgcagcagagcaggaaatcagatgtgggcgctttaagatgagctggtttagcgttcacttacttaaagatcagtaccaagccgaacccccttgggaggagtcgatggctcatttggccccatggggagggcggtaattaaactctgaaggcagccctgatgttcagctaaaagctggtctttaaatagtaatacactcgccttgtaaagtgctaggccctcgggtggctgttgacacagtgcgaggagctggcgcttttttctataaaagccaaattgaagaaactgttatgaactcatctgcataaagcaatatgattttgcctgagggtgcaggcaatggggagtgattaaccaaccggctctctccccgctcctccgcagctctgctaacatgccacttgtcactaaaaaattggagacaccatatgccaggctgcctctgctgagcgccccttactgatgccacgcgaggaatccctccccaatttggggggctgcgggacactgcgcagtgtctgtctgtagaggaaatgctgcctgcctgccttcgtcttgctccctgcctttctcagcaaggacattccattgttccagggaacgtggcagagacgttctgagtttgcttgaacaatttgaggcacatttgaaggacagtggaagcattgctccagaaacccagtgtccagacatcttgtttcctctcctccctgtgctgaaggctggaagaggtcccctgtggctggttctcatgacctgccttttgattccaccggtgtctttgtacttgtgcaggaaactcaggagggcatgccttcctcctgcaagccttttatttctcctaaaacctactttgcgttctgtctcccgatttttctgtgctccattaattatgcaaacctcttttgattcaatgtgcaaacagtgcattaaggttttaaccttgaggagaatggttttcatgaggcctgacagctgaatcccaggacttggaaaaggagacgactgtgtttggcttttgaagaattagctttcacgtccctccgggtgataggtttgggtgcagagtggcttctgggctgatttgattataagccaccattttgtgtttccctcagtcaccagaattaagatctttctaacagcaggcgtgtaagaagcaagaaaggaaggccgtggtgtgggagtgtggagaaaaatggattctagaaaggttagcaggctgtcttccttgctgctattgtgtctacaccgggggacagtggggtcatgtctgcctctgggctgtcttccccaggatagacagggttggggacagagaggacggtgaggattccccatgaccaaggttgggctgctcttggctctgtcttagttgctctgcttgatgttatgaggggatttggatggggttgacatgggcctcaagaagaaatgcttctcagcccccttgcccccaataactggggggtatcagcctttagaaaggatcctccaggctcccaccccagccccagcccctggagcaaaaccacattctcactaggcctctcctgaaaaggggaagtgtaagacgtgacttcccttagaaagacctgagcttctctttttctatgggttttggggtgaggccagcagtgacttaatcccaataaatattaaatgagacataaatccaactttagcaaatgtcacccacagatttttgctaaatcaaacttatttgtattttatttttttaaatggatgaacttcatctcgaaggaatataaaaaaactgacaaaccaaaggccactgaggtccatgcatggactagggaggaaaaccccatgtatttactgccagatccatgccaggagctgtgcttgggcgaagccatagctggtggcataggtattgtcaccccctactcctcacatggaaactgaggtggctcagaaaagtctacatgatttgcctaaggtcaaaaggcagggaagtggctgttatttgaatccagatctgtcagacccaaagcccatgatctgttggccactttgccgtttgctttgggccagagtctgcctgaggccctggcagagatgtcactgactgggcggtggcccttttccagatacatatccccatgacccaaggaaatgctgctcacagctaccctgagtgtgtggacccccagctctcctgcacagcttcctactgaaaatatctccccatagatgccttgtgaatcattttcccaagaaaaggacttctctacaccttaaccctctttaaaaatgcttgtgtcctaggaggggagaatgtacccgctgagtttcatgcaggggtcttgtcagggaagacagaatgagtgcctatgcactgccaggtcctggtaccagatcacatcatttaagtattacgaccaggttactagggattatttggatcttcttttgtggaggagggaacaaaggctcgccaaggctggaaacccaccaaggtttcccactggtagagaaagcccagactggacctgactttctgttcccaaagcccttgacacgtggccactccagtcactggttttctcagtgacagactggctgggctacacacaagggggctaggggctgaagccactttttgaggtgactctttgttctcccctcattcagtaagtgttggaggctggtgctcggagccatagccagaccattgctggtgccagctcaatgcctgcagtgtgctgggatggtgtgcatatttcacacatcatctcacacaattcttacccctgccaagtgtcccaggacacctgttttagagatgaggaaactgaggttcccagaaagtcagtggcaggtgcaaaggtcatgcctctttgtgtgacttctctgtggtctgtctggtttcccatgacatttctggcttttataaactattaaagcacagactgaaagaaaaagtgggactttgcaggtgaggctgtttaacgtgctggaagagtgaatatatgtaaaatttcggatattacagggctgcctatccccagtggaggttgtctgggcagaaatgatttccctgatttgtgaagattaataaatattttgtaggtccttggtcaactcaggctgctgtcacagaataccatcgtctgggtggcttaaacaacagacattgatttctcaattttaggggctggacatccacaatcaaagcaccagtagatgctgtgtctgctgatgtccatgtggctttcagatggtggccttcttactgtgtccttgtatccctacatggcacagagcagaaggacagaacacaagctctcatgtcttttcataagggcactaatctcattcttgagggcttcatcctcatgacctaatcacctctcaaaagtcctacctcctaataccctcacctactggggtttataatttcgacaaatgaattttggagaaacataaacaataggttcctaaattttgaattctggcgcctattctacctttttttttttttggaaacttttaattaaataaaagtgaatacatgacccagttttcttatttggaaaaaagtgacgcaagttcaatttgactatcaaatgcaaattgaaagataattttcatttggaaaggttcaattgataaatatataacaacaataaaaatggctaaagtacatttcctagggttgtcataacacattaacataaactgtgtggcttaaaaaaattattctcacagttccagaggtgggaagttcaaaatcaaggtgtcagcagggtcgagctctttctgaaagctctagaggaggattatttttgcctcttccagtttctggtggccccaggcattcttcagcattccttggcttgtggccgtatcacttgaatctgtgccttcatcttcgcagggggttcttctctatgtctctgtgtggcctctcctcttcttacgaagacactaattattgggtttagggctcaccctaaattcaggatgatttcatctgaaggtccttaactaattacatctgcaaataccctattttcaaataaggtcacattctgaggttccagaggactttcttaattttggggtgacaccgctcaacttagtacagctgctattcatgtgaagtttccgatgtgacagactcttccaagtgatttgcatatactttgcatagactgcctcccataattcctgttctactccgtgaccaaggcttattcctcaatttctagaaccctgcatggtgagttattttcagcccacctgcctgtattatgaagcttctcccctgccctcctgactcctgctgatgctgcaggaaatttcaccagtgcgatggctcacccctcacttccaggtatcctcttggttaaacccaactcacactgactaagagttcaacttggcacttactgtctatggaacaggcattttcaaagttaaaaagttagcttttgaaagaacagtgaaagaagtgttccccttgggtaggtagatgagacaaataatgaacacaaccgagagcagcaatattttatttacaaatatttttaattatgtaaatttatatgaaataaaacttttaaacaggagattatgaataataatagttgtcatttaatactttcgttgcctggggacagtcctaaaattactaaagtaatgcttggcggctaggtgaccagagactcatgagaagtactaatttgatatccctttagaggtaaaggtggaagactgataccaagtagacagggtttggaggcttcctcaagctgggacttagtttcccttgtagatttgggatccctgcccccccattcctttcctccacagactcactgtggctcccccttcccatgaggtatgaataaaggtgtgaagaagggatgtgtgatttccattcaacctgacattctgcttaatgcattcccctagagggtcgcttgtgataggacatgacctaccccagattctggttctgggtcatgaggccaatgctctgtgacctggctgcccatgtcctcttcatcacttagctaaaggccacctggatgccaaatggtggatcccagtggccatcataacatttcttgtccccatccctataattgattgctggaatcagggaaatggcaggacttcctaggactaaaatgtttaggcctttggggtgttggaggtgaatacatcaggttttaaaaatttatggcatttagacacacactgtcagagggaagaggaatcttacttgtctgacctttccagcctatcaaatattttaaatacttaaacatattttgtatgtgagatgtattctgtattcttttttgaaatgagccagatacattttatttaatgcattgattgtttccccttaaaaatgaatcagataaatatctcaaggagcatatattgtcttcagggaaatgccacacagtgtgatcagcaccaccgcagaggcccgggtgaggggccagtattcagaagaggacacctacctggagctctttcctggggtcgtttctaatattgtgacatgatgctggactaggaagacctggagtctggttaatggtgcaaatatttaataactaggattttaagcactttgctccaagccttcatttccttattgacaaaatgagcaccttagcccattttgggttgcaatcataaagttcaaaagactgggtggcttagaaacagcagacaattattcctcactgttttgggggctggaagtctgagatcaggttgtcagcagatctgtcatctggggaagccttgcttcctgcttcccagacagtgccttctctttgactcctcagatggcagagagcagagctgaagaataagctaactcttgcgtcttttctaagggcactaatccaattcttgagggtcccaccctcacgacctcactaccttccaaaggccccacctcctaatacaatcacagtgggagttaggatttcaacatatgaatttttggggagcacaaactttcagtccatagcaatgagcaattagaacaatttgaaaaccattaatctaacttccacaacatttgagagtagatgctgggcatccaaatgtgtttcttgtgacatcgttacccctaaaaatgttctcttattacagtttcaaattcatgttgaataggtcattcccaacgatatgtatagatagcactgaacattcattttttgagattgagtatttattttttgaaacattctatatattttgaataatcttcttctgaaatcagtcagttagagaacatgtaggcagatagtctcaatgaagaagtggatcaaaaatgccatgtgttttcagaaaacaagtttcttttgttaaaactttgagttcctatttctttttctccatgctcttttgtgtattttgcttggttctttctttgctttcagccactgatctatgcaagtgacattctttttgatcatcaggactgcaagttatcccaaaataatgccttttgttttagaggcgttgccacatctaccaggtccaaaacaaatagaaatttaaatttattccaaatacttgtcttctactactttcagtgcaatacattttgctgaatttggttggatttcttccaagtcttcctaaacatcaatatactgaaaaatcattcttccttaagtataatattattactttattaaagttcattttaatacatgtaatgacatcacaacttgtaaaatgttgaccttaggtcttatatatacttacgcacttatatgcatttatgtgtgtgtatagaccacacacacacacaaatatacacatatatgtgatatattaaacattttaaaattcttgactctgagaaaggcctctattcttttaataaggaaataactttcaatttatgaagtaaactaaaccagaataaatggtacagacaactatttatgaagagcattatgtttaggattcttctcttaaaatacttaaatttaagctttgctgtttattctcgtgtgtttcaaatatgtattatctgatgcttactagcacgcactttattttatttgtaaacttactttccacataggtcttgtttcagagaagcatttaaatatagtctgttactaaaggctggcataaaataagtattgaaatagaggcaattgcagaaagttctggactagttatagtaatgtgaatgcttttttattgaaaatttttatgttatctaatatgcagaaaacaaatgaacaaaaataaaaataacaatggcctgtaaaatgacattcattagtattttgatgtataaaaagacttcccctgtatcaagattatattgatatgcaactggattttcttctaacacttttattgttttatttataacatttagttttgtaatatgcacctgtagtcccagctactcagaaggatgaaagcagggtaatcacttgagctcattaactttgagacatgcctgggccacacagcgaaaccccatctttaaaaaaaaaataccccaaacaaaaaacctttaaaagtaatatatatgggattccttttaataaaatattttctctcagttgttagttggttggctcaatatttgttggtggagtaatggcattaaaaacggattgaagttgatcgaagagggatcagggttgcacagaaaggctgggagggatgggggagctcttttagggcattttggcagaaagcaaaggagatgcgggacccagtagcctaagcagcaccccctctcttttgttcatgtttgtttattaccgatctttttctgatttatatttttaaagctcttatatcctaggaagttttgtttgttgcctccttcactaagcttcctacaatgtggaagaattaaggccatatttagtgacattagaacacaggaagcaaataaaacctgcttctcatcctccagagattcacagcgcagtgtgaggaggggcatggagggacgtagatgtgggtaattaacatcgacagagagattacgctgtgtgtgaaaatagaatctctgagtcctgtgggagcggaggggagagaggaattggttctatctgggaaatcaatggaggcttcttagaggaattgttgtttgatctgaacttttgccttcagaatctagacggaccttaattaatgtttagtgaatggattaatgaatagagtgtttttttgctttctgcttttgggttgtgtgtgcgaaggggaggtgagcgggcatcaaatgtaggaggaacggcccagaagcatgacagttgataattagtcattgtgtgttaagagctcattaattctaataaagatattggagatggatcatacgtgaaaataaagcaccccaaatgcataatgcaactcaatagaaacaaactgctaaaggctatcgacactaacattatagtactatgcaagtaaggacaggttttttggccatatttttccatagcatctaggaaaaaatagaaacgtgaaaatatttgtgagtacatgggaaaatgattttatgttaataaagccattaggtaaaacgagacacaccaggaatgccctgggtcttatctgcatatagagactatgctttcatcttaatgaaggtatctggtccatattttcccttttcaaaaatctcaggaattgtctttttttcaattaataacatcataatatcccttctcatcttataagaaacagagatacacaggaccaacaacaaaaaacatccttgctcttgatctgtccctgattataagtgattttagctgtatttcatttcactgattctgtttgcaaacaggctttcacacttgtttttaagaaataaactccttttctcaaataaaatttcactggaaatcccaatttttcttttttttttctttttcttttttttgagatggagtctcgctctgtcgcccaggctggagtgcagtgacacaatctggggtcactgcaagctctgcctcccgggttcacgccattctcctgcctcagcctctccgagtagctgggactacaggcgcctgccaccatgcccggctaattttttgtatttttagtagagacgacggcgttgcaccatggtctcaatctcctgacctcgtgatccgcccgcctcagcctcccaaagtgctgggattaccagcgtgagccaccgcgcccagccatggaaatcccaatttttctaacaaatctcagcgatgctctggtggacccggtgtggacatctggggtctgggccctctcggcctccccaaccacaagcttgtcccatggagacccctaaagcttgtctgtaaaacatgggactcccttaagtaatcactgggctgtggtcagcgaggttccatcctagtcccaagttttgttctatgaaagtctctgtctgggtttcttttcatcctctaaaggacacgtttttctcttcattttacgagttgattttcctttgtgctgtttcatcctctactacttgacctcatgaaggaaagacggaacccagagaactaggtattgcccttcattgtgtctgagaccccgaataataaattagagcagaaatgtatcattgtctttcttctctcctccttcccctcccttgtgctccatgttccccagtctcatcaagcaattctacctgagaggccttaagatctgatttgaacaccacggccttgatgactttattagcaggcggttcaaggaccacactgggaggaaagaaaaacaaaacacaacagaaaattaaaataaagtaaaataataccattgctccagaattcattgtatggcaaacacagaaagcacaatatcaaggcaaattttgatttcatacttaaaagttgctcgcttttagttttgggccaaattctgcttggtgtcaaaatggggaaaccagaattgttttcaaaagatgaaatatttcccaataataatttaaaacttggacatttcacagctttgtgattgttagaggaaagtacttgggggagtggcgcattttggttgaagccaacagctccgggtcctacaggacagcgtgatgggcctgcttagcttcctgctgtgcttggcgtgctgctgtgcacggggttagctttggattcatacagatgctgtcatctctttcaactggaaatgaaggagcactaacaccccatctcttgatcaaacacgtgacctctgagtggagagggcagaagggctctcaggagtgagtgaccgatgggagagaggctatccccaaattatttggctgtcaagcagacctttacccaactgagtggcccctgctctgcctctgtgtcagacaaacactacatccatccctttactcattctcttgctccactgctcactcactcacctaccacttagcatttattgagcgctctctctgagatccagagatgaattccacctgggtcccacttcagggccctccaaaaccacatggaaggaggaggactacttcatataatgcgaaaggtgcttgggaagcgttggtttgttggggctgctgtaaggaagtacagccagtgacagaaatgtattgtcttacagctctggaggctgcaattctgagatcaaggagtcagcagggctggttccctctgaggctgagagagagtcaattccaggtctctcccagcttctgggagtctttggtgtttggtgatttcatctctgccttcatcatctcagggcattctctctgtgtgtctgtctgtgtccaaatttctcctatttataaagacaccaggcatataggattaaggacccgtcctactctactataattttgttttgtttaattacatctgtgacaaccctatttccaaataaggacagaggtactagggattagtacttaagcatgtgagttttttggtgggggtggggaatataattcctataaaaggtagcattctctcccagtaatttcttcttgaggcattagatgtcacaaataaacaatgttagttttctcagagtttagttactcaagagtgctgtccatttgtggacatgtttgcaagaggagaaggcagcaccgatctatgtcataaatcagcctgctgtctgtctgtctctctctcgacctacctcccttcctcaccacatattgaataaattatactgagtgatatgatatttcagtaggcctccaggaactttgttcagtgaaaagagggtttgataagttgttaaacaataaattaatcaaagtgctcaatgctaagggactttcatgggtatctctgtggcccatgagaatgttctggaaagccagggagagaaaaagatgtttctcaagtcatgagctggagtctgagacctgaaatgggagtagaaaatcctctgccttttcatccggaaagtttggaataagttaggtgttttgcagttctaggagcatttattaaggggcatttcctaagtgaggcagtcctgttctggggatgcacaaggaggcaccatgcctctggccttcaaagctgtcacggctggacttgtttttaaaattcgagagctttaaatcaagttcagaaatcattgccaaaattttctgtgtcctctttacgcatcccaaaactgtatttctgtgtcagccgttatattatgtccttacaaaaattaataagaccaaatcttcaccctgaattagattagaatctaccgggaccgggtgcagtggctcacgcctgtaatccctgcactttgggaggccaaggcgggcggatcacgaggtcaggagatcgagaccatcctggctaacatggtgaaaccctgtctctactaaaaataaaaaaataaaaattagccaggcgtggtggtgggcgcctgtagtcccagctactagggaggctgaggcaggagaatggcgtgaacccgggaggcggagcttgcagtgagccgagatggcgccactgcactccagcctgggggacacagcgagactccgtctcaaaaaaaaaaaaaaaaaaagactctaccggtcagctttggttttcaaaatccattggtagagtattggaaaacctttgaatcttagatggtttcacatcacctctgtaatgacctgacctctaaatataaggtcatattctgaggttcttggggttaggacttcaacataggaatttagggggtcacaactcaacccttaacagtgtcccagtcggcatcacaggaaatcagtttccgcttcttctccaaccataaaatcgaacatgctgatgcccactttcattgtttttcgcacatttgctggctgaatgttggacacttacgtttattaaaggcatgaggttcaccattcagagatgtgatgtaaagtaacgtctcaggctcaacactgcactgcagtgggtgtccttgtaggggcttctttatttgccttgagaattggccacagcacttacctccagcttcttgcctataaatacttctcaaccaagtaggtgtttttttctcccaaatcatgatccatgttgaccttgcaaggagacaaagtcctgctttaaatactttcaggtgtggttggacctagacatctctcactatctttgaaccagttggtcaccttgctccatttaggtgtatctgaggtgccgcgtctctctacagtctcacaaccaccaaccttcagcatgttatgtatttatctgcctgtcattcccacctgactttgagcttctcaagggcaaggattggctcttatccatcctgtctcctctgcacgtagcacagtgcttgctacatatctgatactcaactaataatgtacattaagaaatgagatgaatatatttttgaaaaatgtgcttgcatatctacagttagttgagtctctacagtaggaatgatgctgataatttattttttaacttcgacaaacactgtgactcttacatcctgattggtaaaggctgaatgaaagttaaggaaactaaggcttattgagatacaatgtggcaggcatttgccaggatctgaacacacgccatcacatttaaaccacaccctaactctgtttgcatttttgtctgacattatggttgaggatataagtctagggaaattatttgctcaagttattatatgttataataaggagaaaatgaacattttgtttttagtgcttattcacatgaagcactgttctaagactttaaatatgtattatcttatttaattctcccctacacctttaagatagagagtgtcattgtatccattttaagaatgaggatacttagacacagggaatgtaagtaaatatgcagatcagatagggagcaggtggccagccagcatgaaaacctagtgacttggtatcaaaggttacagtcttaactgtgaccacctcttggggaaccaagtcagacccaggtatgtctatcagaaaagtccatcctcttgccccaagctggaaccccctatttttcttattcactactagatgataccacgtaagtttagagattacagaggtaatattgggagaaatcattacaaccgcccatgatttgatgtcattctgtactttatttctaaatcagaggataattgataatagattaaattaaaataagtaatatagaagattattttggggtaattaccttacataaaattattgagtaacataatagattactttttaaaaatatatcactctatatcattgccctggatagcaagcaagatacctgctcttcaaatgtaaagaatgtttttcaaggcagagctcaagaaatatgttcataaaaatgaacacttggtgataaatgtcatcatcctgcagagtgaagcaagagttctggggacatgcctgtggagtctccaggtccacatcaaggcggggtacacacatggatcaccccaagtctaccctttgtgcaggaagactcccttcagctaccctggagatgtgcacattttctagtcgaatttcctatttttccctttcttacatacaagaggaagtaaaaccttgacttgcttctgaactgtcacaaatgacatttacttttttccctgtggaaactacttgaaataattaatatccaagaatataatctttatgcaactactttactcctagagaaattccaaggttagaaaatgtcaaaaggaatctgaattgattttgccacctggggtcaaattttctattctagttatgaaagtcaattttcataaaaaaatttcacatactctaacctgggaatatcctaatttcaatgaataaaaaacatatggctgcctgtttaaattttgacttttaatgcagaatggtggtatttagcttttaccttctattttataaaattctgttattccataggaataaagtagatgcagatttatcaagtaaattttaaaatatgtggccattttaaaatgagatcatacttgcagcacatcaggtattagtaacagaagatttatttaaaagaaaatcaaatggatttcctttcagggaaaccacttgaagaagctagaatattgagagtgatgacatgttccaatcacctaaataggttttgaagcttcattttcaaacctagatggaggaaggaagagatagaaaaacagagggttagatggaaggatggatggatggatggatgggtggatggatggatagatgggtgggtgggtgggtggatggatggatggatgaatggatggatggatggatggacagatggatgaatggatggatggatggatggacagatggatggagggttggatggatggatggatggatggacagacaggtggatggatggttggatggatggatggatggatggatgaatggatggatgaatggatggatggatggacagatggatggatggatggctggttggatggatggatggatggatggacggacggatggatggacgatgggtggatggatggatagatgtttggatggggaaatagataggtggattcatttcctttaacaatgcttatatgttggttttgtgcatcagatcttgaattaggaaatcagagaaagaaacaattttcacatatatcctggaatatgcaaaatattttgtacatatatagagcaatgaaaaggaaattattcttacatgcattcacacatgcctggattcatcacacacattggcaggaggtaaggatagttttgattatttttaagccaagacaatgaggtagcgtttattctctttacagtatcctgaaacaatcttaggacctacagaatcccttttcactcagattccctgcttttgctgactaactgcaagtgaaacatttttccattgaacttgtaaagttaattcaattaagtgactttattttaacccacgtctgtccaggcttcggatgactgtgccatccctcactgaggctgtcacggtggtccctggggccctgtgaaatgcccaaaagcacatatgcgcacatgcgcgtgcgtgtgcacacacacacacacacacacacacacacacacacacacacagagccttgtggctgttttgaagcaccacccccgccaaagtcctacccagggccattccatttgcaggtttctctaaccccaagttctctcttctccaggtcaccccatgctctctctcccccaggttaccccaggctctcttgctctttcctttgagtctctgtacttatgtcccctcatcaggatgcccttggccatcttatatcagcagcatgcccccatcacccatgatcttctttccctgcttgctttcttgttccggaccactgagctaaagccctcggcaagaactgtctgaacactacatataaatcatgacctgcatgagacatttctgaccacctttcctttatgtttccctatagctttcattaccgctgcacataccccatgcttgcttatttatgtgttgttttttgcttgccttccatgtgtctagaacattcatgttgtctgctcattcagtgaggcatctcagacacctagacttgaagtgattctgtcacaaaatagttcagggaaatcaatctgcaaggaggaaaaagatggatcttttatttatttttttaacttgacgtcagcaactgtcttatctgatatttattagtatttcagattcattgttctttttttgttttccccagtggtttgaattttaaaggaatttctttgtataaagtattttaagcaccctcttttatataaagtattaaatcataacattgatttaaagccatttaatttgtatgaccttttaagcagccgtgagagcataaaagaagagtgtatcaaagcaaaaagtaagaactcttgagtcttttgaaaatatttactttgaacagattgcagctccttaaatgatgaggctttggaatctgggaggtggtcagaccccagctctgcctacttgaggccacccacatgtcgctggacccactgtgtgtcctccccaagcccagcacctcatcttcaaagtgacacccacaatagacagctgtgcagagcattgagtgggatgctggatgcagaacctgccaaatatcactggttgctgatttatcagtttaattgaatttctgctgcaaaagaaggaaaggaatgggggcaagacctgcattttccatgacaagatttgtgttttgatggcagggaatgtgctgcatgccacccacctgtgatgcaaccactcaggaatggggaccaaacctttttgcccatctctcctccttccttaaggctgagctgagagctctgggttggaatttcctgttggaatctgctctgttcttccttcacccttgccctgagcaagctcactgagcagctgcctctctgagccgggagctgggcccagtggtggaaatactgacgtggtccctgcccatcagtctgcagtgcagaggggaaacacacccaaggctactgtgggaccctggggtgtgctgggtgctggagaaggaccgtgcaggagcttgggcatgtggctataagaaaggacaggtaaacggagacaggggtgaatgaagaatgagacaggtgtggtggctggaacggtgtacccagcagagggaacctgatcccagagggtgcataatgcgcctgagaccggcagcagccttggggagagggaggcagattccaggcaaaaggcaagctgcaggtgccagcaggaactgtaaaccaccatgtcctgcaagccttggtggttttggctctgctggtgttgacgagacgccaagaaggagattgtagctggagagagacaatcacgttttcagtgtaaactcttattctgcctgaggtgtggaaaatagtcgtgggaacgaggctgaccaacaccagaagcagggcactccttgtacatagttcagtcgaggggagtctagggaagcctgaatggatggttggatggatggatggatggatggatggatggatggatggatggttgaatggatggatggatggatggatggatggatggatggacaggcagggctgagagatgttatggcaaagaggcatgtagctttgatggacaccacggatgtggacagagtgaagaaaacagggaggatgttgtgactcccttatcgagcgatggggtgggtggtggaaactgtggctctaggaggggcctgaggaaatgtgggtttagggtggagaaagggtggtttggtattccataggtggattctgaagtgtcctgggatttccaagtgagaggaaaactgtctctatagatgagaaaaaatattttcttagagcattttaatgtcaaatagaacttattttaggttatttgtcattttaaattagccaagcacttgagtctttctatagggtggatatgcaattgctcagaattgtcttatcatgacacagaatgggatagagcatttactttcagtgtaaactcagttcaagacaccacctgttatcagagctcccaaaagacaacttgtagacaaccagtcaactgaagggctgaaaattattttttgtgaatatttaaaaactttttttaacctgtagttttgtttatcaacaaaagtcaaattgagaaaagagagcttatcaaatctgtatgtgacttaaacaataaatggagtttcagttcctgggtaagaaaattattctaaaaagaaaaccaaatcaggaggagtcaatggtgtttctttgtactgagtttgtgtctgtcgtacaatgaccatggaatggtgcacttggtttggacaagtcacttctgggggcagtgtggagctacagcagagagcaactgagatgtgagcccagggcaattgtataaggtgttcagttcttattatttcatcatgttaaggcatctcttgaaataaacagcacccttagagttaaagcaatatatctgtgacatagaaattgtttctccaaagtattgctggggtcaatgggaaataagcaacgacaagcctgttcccataaactttattgcctcctgtaactgactttctaagtaaataaaggttcttagttttgcttttcttgcagaaaggaaagaaagagggatacccgagggatagatagccaagagttatgctaattctctgatattttataataaaagagatttcatctaaaaagaaaaggaggttctgaaggtggttatgtacattcttccaaactcaaagtcacgtctggaacattcttatatggaaagagctaaaaatacttaaaaatttaccttgaacatttctcatccaatcatattatggtccaggcaggtgctgatatgagggacatgatggtgcaatatcctttgacaagcagaagggactgtgagtctctgaggatgggatgcagacctttgatctgctccataccaactatgaaggaggtccatgtgcttttgaaacacattgtaaggatccaagactttgcagttaaggttgctcctaataaacacaagctaatagtgcaaatatgattcctgtgcaaaggtaaaactatttaacggccactaagaaacagcaccctgttttgtaatagtaacatgtaaaaccaatggcagatgcatgccagcgcctcttagcactggagagcacagtgatcactgccttactggagaaacttcccagaggggagtgccatggaatgctttgaggaagaggaggggctaaaaatggaaagcctaggccagaagcagtggcttatgtctgtaattttgggaggctgaggagggcggatcacgaggtcaggagatcgagaccatcctggctaatacagtgaaatcccatctctactaaaaatacaaaaaaattagccgggggtggtggcacgcgcctgtagtcccagctactcaggaggctgaggcaggagaattgattgaacccaggaggcagaggttgcagtgagccgagattgcaccactgcactccagcctgggcgacagagtgagactccatctcaaaaaaaaaaaaaaaaaaaaaaagtggaaagcctggacattgccaaagacaaaatgtgtctttcatcctgtccatgaggaggctctgactgctgctcacctcgctggctgctgctctgtcttttatcctctaggattctgaaagcagagacaatgacttagcaggtgagttactgaggccaactgagcaaaaacaaaggacagatggagtacctggcagtggaggagtagggacgtataaagccatccctcaaggcttgtgaccttaaggaatagaccagttagttagaaagacaagatgcacttgtacaaaatttaccaacagtatgagactatggtgctagcaaatgtcacagacatgacgattgaagtagaagaaattcttggctcaaggaagagcaatatccagtatttactggaaggaatattttaaattagtgctgttctagaaaattcagggcaatggctatgcattattctatttataaaacatttctacacactctatgtataataatgtataacaaaataacaggccagtaattactataatggagtataatatagtatattatgagaactggaggccaagttctcagaggaagccactttattccttaagttaatatgatgaatctcgctttgtgtctcttatgccttatttgagccacacagaggaggaaagaggagaatcccaacacatagtagattcttgaatttcaccattaaatatgggtcaggactgtggctatggctgtgcttatgtcatggagagctttgtgaaattaaatcaatgatgatttatgaagtcatcatcagaacatggtagaaatactatggttttgggcactgaaccaccccagtgttgaaaggtttgctttttggctttgaggtttaaaaaggagctgtgatattttgagacacagagatgatggatggcagccagaccaggttaccttacatggcagaactcctggagatgactagtggcatgattagagcatccgctcctgtttccacagctatgaggcgggtggtcttcagataaaaggagagccgcatacagggtttctgtctcaggatttcacccacggttcttcctccagaggcaagggtgagcttcatgtttcctttgcaccagtagcaatgacagcagaaacaggcactgcaatataattatactggatttattccagggtgtatctgttatttattactgtataacaaactacttcaaaacttagtggcttagaacaatggctatttgtctagttcatgattgtgtgaactggcaatttaggctgagctcagttgggtggttcttctgctgtcagctaggttcagtcatgagtttatgagcagctgcctgtcagagaggtggctcttctcctggggttggttgccagctatgtgttaggaagataaggagaactggatcattgtttcctgttgtccagcaggcaaccctagactacctcacatggtagctcagtaggtttcagagagagagtgtgcagaagcttagactcagtgctggtacacagcaacttctttcacattctgtgggccaatgtgaaatacaaagatgccccatgtggctagagtggagaagaagactatgggacttgataggaggagttgtgaagatcattgtaaaggctatgatacttggagacatggaggattatggctatttttggcatctaccatacatggggtagattttgtctgaaggcagtgtggctggaagcatttaggaagtgagagcttcacctgtatgtccatatagggacactatcaggaataggaaggtcagagaaaaatggagcttaacagagcaaatgccctaaagagacacagaggccagagccacctgcttggaaagatcagagggatggaacagcagggcagggactttaagccacaccaggcagtgcaaatgctgctaactttgcaggggctcaggaacacaggccagggaagcaccttgacctcctggctccaaagctctgagcatcattcttagaaatagctcccctgccagcatattttgtaccactgagaaagtgactcaggatcaaatccagagctctgttttttttttcttaattaactaattgattttgacaaataaaagtgctctgtatttaaattatataacacaatgttttgatatatgtatatactgtgaactgagtgccacaatcaagctaactaatgtattcaggcctctgttgaagtgccctaatggttctcttcaaactgctgcaaaaatctgataagcaaagttcctggccagcccgaagttacctcgagggctctcattatctccctgaatcccaccccccggcctcacctaccatgccatctctcaccccatcctcttttggcagatgtccttgtcttctacacacctgaaaaggggaaggcatccagtttcatattctcattgcagcacctgtgtcagttaaggcttggatggagccctctgagtagccttcacccccttctccctgaataagccaaataaaagtgggtttcatttgagggagtgacatgtccctgaaaggcttggccttgtggtaagtcacaaacaaggcatgaacaatattcccaccttctcctctctgctaagtacttgccctgaaaaaaactaagttctgcaaagtgctcagagggtttaggtgtgaaccacccagctggaggcagagttatagctctgcctctgggggccagctccagctgggaggttgatgggagcctctgacgctgggctccccgagaagcaagatcctagacaagaatttgagtgtaaggaacttctttcagaggcaggcccagaaagtatcctaggaaattggggaacggacatgggaaagaaaagaagtcagtagagagggtgttgtccagcagtttattggtgtgggaaactggggttcagtcccacctggggcccccgagagatttggtacagtacacttcaaatgatcatgtctgagataccaggagcccaccttatctatggctgaggtctgttcatgctctgtcttgtttgctggccaagagaaggttctcagatggaaggccacaggggttttcagtaggagccctcttggctgagactgaaatgagggtacctcaaaacattaagtgaattttctgagaccatatagctgggagctgagtctgtctaattttaaagtccttgttctttaacaggagaaaagagaaaatggtgacaaataagtagtttcttggatccaagacattgagagtggctatttcctccttgcacagaaggcttcttgatggaaaccaaattactctgaaaagttactagttttaatatcttagcaaatcatttgatacattcacggaagtgtttatcagcaatgtataattgttcttctcacttaaagaatgtttgtttcatgacattggagatctgtaacacaaagacccactttgtatgatgaacccccgtggtgtagctgcttacagggccctcacacacactcttttggtccctgaccacatctgttttaacctggttctgactataccactgtccactgctagacagaaaagaggaagacatgcctcattctccaaaaactggaggaatggcatcattttcaagtttagtttttgttgtttccaagtatatttatgtaatgctgtattatatgtatatacttgccatgaattaaatacgtcacaaataaaatccacttttgggactcaacagtatgtaaaaacacaagtagtatgaacagatttatttataaagttatgatgagcctttctgaaatctttctagcatatcactggtgtaaatgtcatgggaattgaaaataatgtatttgaatttcacagtcttctgtgaatggattttttttttttttttttttttgagactgagtctcactctgttgcccaggctggaatgcagtggcatgaccttggctcactgcaacctccacctcccgggttcaagcaattctcctgcctcagtctcctgagtagctgggattataggtgcatgccaccacgcctggctaatttttgtattttttagtagagacagggtttcaccatgttggtcaggcttgtcttgaactcctgacctcatgatccgcccacctcgtcctcccaaaatgctgggattacagctatgagccaccacacctggccctgtgaattttttaatactgcatttcccaaaaagaatttgtctttctctactttttaaaaaaagttttccctgagtctattataaagtcattcttgaccagaaaactcaagcaaaaaaagaatgaattagttgacttgtccagattctatgtttagcagacatgtgtaccaagagtttgtattgattgttaatacatgataacacagaaagcgctgaaaaatcttaactctatgtaaagtgtttatatatgtatataagcacttaagattttatgtaatataactttttctattcaaccttttaaggaatatctaatattttaaattactttatcaagcaaagaaaaaggacaagtttaaaaataaaaacatagaaaaggaaaaaaaagagaattatcctgtggtgttctctcattaacgaaaaataaaggtttcggaaaatctgttaattttccaaattttagatttttatgtgctattagattggaaaatgacagattaaaattttgaaaaatttgttcatgaaaattctaactttaagttgctcatgatctaaattttcttagctctcatgagatctggttgtttaaaataaataaataaataaattttcttaaggacccaactgccactaagattgtttaaatggtagctactggcattttttgttataagccgaatttctttcatcaaatcaagctcacacattcactcaagttcttaagatactgttgaaatgggaaaagtccctttgtccccctctcagggtgtgtgatgggggtgtggctcgtgttttcggtgcctcactgctcaaactttcaggagagggcatacagacaggcaggctgtggtgactccgaccccatggcagcgtctagaggtgaatgtttacagctcctgaggccccagtgtgtgtgtgtgtgtgtgtttgtgtgttactgtgtgctctattggtttagcatgtgcaggtggcttgtgcgtatcagatcaattagactcctgccttatcacaaagacagagggcttttctgtatcccaggatttcttgctttgctgtaccagaagaatcagatcacacctgggcttggagaatgagtgcaaggttttgttgagtggaagaagctctcagcagatgggggagccagaagggagatggagtggtaaggtggttttcccctggagttgggccgctcagccaccagggctctcctccctctgcctccccgaaactctgcggcattcaccggtcaatggcctgctggcctgctggcttctgtcggtgtgctcttaggccggtgcattcctcccgaagtccagccacttgtgtctttttccactgatgtgttcctctcaacatccagctgcttgtgtgcgtgcccgctagagtctcggggtttttataggcacaggatgggggcatggcaggccagggtggtcttgggaattgcaatatttgggcacaaaaacagaaatgtctgccttcacctaggtccgtgggcacaggcctgggagtagagccctagtcagggaccacaacctcctctacccaacacttccctgcccgcttctgtatcactattccttcattaattagaaagtatgcattttttaaaattatgaagtgtctaggtgtctgccagcattactcaataggaaactccaatagaggagtaaagttatttctccaaggtcaacaaaattaataaatacaaagccttcatcaccagagccgtggtgaagagctctttgcactatgtgtaagcgaaacatgaaatcaacaatttatttaccttcagtgtaaattgttcattgaatgtcattatgttgtcgattattgattcctaccgcatgtgacaattacatgtgcttctgccttccctgccctgagtaccaggctgctttcaactctgggcagcaaggtggcaagatagagttgatggagttgcgaatggaaacaggaagatttggcatctgaatctcgaaaactcttgacgaaaattctctttagatacagagatttgataacttcttaaagcgaagtttgttttgctcatgacgatcacacctatcagctgatcaattctgtttccctttcaaggaaaaaaatatgtatcctgcatcagcaaggattcatgaactaaaggactcacagagtagaactctccacttttgaaactgaggagccaaggcccaaagagaaaacgtgacctagatttagtcattatttattgttttaaaggggggacaatcaaattaatgaaggcagttaaaaatacattgcattcttattaaatacattttgtaggatttatgcctgatgatcatgaacatcaaatctgactttcctgttgagcaaaatgaactataatcaagtggaacgaattgctttgctattatcccttgttgtggatttgtgtcagcacatggtaactgagctgaaatgggctttgtttgcttagctcttctcctaaggagaacaacaccatttactctgagtttgtactgggtttctgtctactaactgcttatattggccttactttaataaagatttctatctcactccttaatacggcacatgccaatgggaaacacataccttatgcctagctttgtcctatagcagagtttctcaacctcaacccattgacattttgggcaaaataattctttttctcggggagggagtggcgaactgtcctatgcatttttaaatatattttttaaaaagtttaattgacacacaattattgtacctatttatggggcacaacgtaatgttttgaaacgtgtatacgttgtttaatgatcaaatcaggataattagcatatccatcacctcagacatttatcatttctttctggggaacatacaaaatcctctatgacagctattttgagatgtgcgtaccttgttgttgactgtagttgccagactgtgcaacagaacgccagcacttctcctttctcatcgttaactttgtacccattgaccctccactccccatctccctattcctactccttaccccattctattcactatttttataagattgactttagatttcacatatgagtgaaaacgtggtatttgaggggttaatattcagaatacataaggaactcaaacaggtcaacagcaaaaagacagcaaaaaaaattaaaaagaagatatacaaatggacaacaggtatatgaaaacattctcagcatcactaatcatcagataaatgcaaatccaaaccacaatgaggtatcacctcacttcagttagaatggctattatccaaaagacataataagataacaagggttgctgaggatgtggagaaaggaaacccttacacactgtgggtgggaataaaaattagtaaagccattacggaaaaaagtatagcggtttctcaaaaaactaaaagtggacctaccatatgatccagtactttcactcctgagtgtacatccaaaggaaatgtcctgtgtattttaagatgtttagcattatccctggcctccacccactagatgtcagtaccacccaccctctcactcccagttgtgacaacaaagaatgtctccaggcattaccaaatgtcatcagaaggtcaaaaatgaccccggttgagaaacactgttctacatacagtagggattcttgaattattgtaaaacacagaaagagtgcttttaagttgtttgaaattttattttattagaatctatgaaagtatttttaaatttttagcaatacataatatttgtacatacttacagggtacatgtgatatttttaagcaaacaagcaaaggccatttaagctcaattctcatgtgctaactcaaatacaatgatttgcaattccttatatacacactacatcacactacatatattttctatttatttatttatttttagagagagagagtcttgttctgtcacccaggctggagtgcagtggcacaatctcggctcactgcaacctccaccttccaggttcaagcgattctcctgcctcagcctcctgagtagctgggactacaggcacacaccaccatgcccggctaatttttttatttttaatagagatggggtttcaccatgttggccaggctggtctcgaactcctgatctcgtgatctgcccgcctcggcctcccaaagtgctgggattacaggtgtgagccaccgtgcccggccacacactacataacttttcatccattctcacgttagtgtttgtgttttatttcctcctcaagaatctataaaatataaaaatatttaatgcatttaaattgttgacagcaatctttgattttgaaatactttcatgaaaagcatattttctggaagataatagcattgcattgaatcctgctcctcttaactgacttgctataattattgcagagaattattttctcttgaagaaagatggtatttaaagtaaggtataactactgacctgtgtgcctctagaatgagagcaagtaagtataccaccaaaattcaactggaagtttgtagttttatggctcctagaatttattctaggagcaatttattccactattgcaagctaatctacttcacatataatttagggcaaatgaattatgtcattaaggaaacatattcatttagagttgttaaatgccttctaatagatgcaagatctgaaataatataaatatgtgcttatattaagagtcaggggcaacaaattttagagtctagaatgttataagaaggaaggtcatgtgttttatgatttgatttaaactaccctagtgattcaagttacctagaaccaataatcaacagggtattttatatgtgtatggacacacacacacacgcatacacacacacagagagagagagagagtgagagagacagagacttaaagaaattggcccacacaattgtcgagctggcatgtctgtaatctgtagggcaaagcaagaggctggaagctcaagaatgatttctatttttatgttatggtcttgagtcacaatttctcctctgggtgtcttagtctatttgggctgtcacagcaaaaataccataaactgggtggcttgtaaacaatagaaatttcttcctcacactactggaggctgaaaaatccaagaataaggcaccagcacatccagtatctgttgaggacccactccctggttcatagacagcgccttcttgctttatcctcagatggccaaaggggcaaggggtctctctcaggtgtcttttaagagtgcacaataccgttcatgagggctctcaaatccccacctcctaataccattaccttgtgggtaagaatttcaacacaaattttgggcagatacaataattcagaccatagcactgagactttttttcataaggttctcaattgactggattgtagatgttaaccatatctacaaaacaccttcacagcaatacccagattcgtgtttgatgaaataactgggtattattacagcctagccaagctcacacataacactcaccgtcatatatttacacatgcctaggaagagtaaaataaagggctatctggacattttcttgaattaccagattcataaatacagttatgtaccacatagtgacatttcagtcaacatcggactacatgtatgacagtagtcccataagattataataccgcattttattgtaccacttttatgcttggtatatttagaaatgaagtacttaacattatgttccaattacctacaatatttatgcagtaacatgctgtatgggttagtagcttaggagcaataggctacacagtaaagcctaggtgtgtagtaggttatgccatctaggtttgcattaagcacactctgtggtgtttgcatgataatgaaattgcctaatgacatacttatcagaacatatcccactgttaagccatgcacagttgtatcatgatggatggatgttcttcctataactcaatgaagtaaaattttaaggttttaggtggtgtgtgtgtatatatatatacatatatatacatacacacacatacacatatatatacacatatatacatgtatatatgtgtgtgtatgtatatatatgtgtgtgtatgtatatatgtgtgtgtgtatatgtgtgtgtatgtatatatgtgtgtgtgtatatgtgtgtgtacatatatatatataaaatatatattatatatattatatatataatatataatatatatataaaatatatattatatatattatatataatatataatatatataatttatataatatatataatatatataatatatattacataatatatataatatattatatatatattatatatatatatgggcaaactgcattgaaaatatgtgcagatggtctgcgaggctctttgacagactggctgccacatgtcagcagatgactgggcttgtgcctcacccagcaagacaggacgcatctcaggccttcagggtctcttgcaaatggtcagaactcaagggtccattggaatgcacacacagattcctattgaattggaatatcggctattcactctgtgtttaggaatactcagtatcgaggttcactaatacccatcatggaggttctatgtgccctccttggtcccctgtgtccctggacccaaggtgtgcccaccctctgcatgaagcacccatgtctctgtgaaccaagagtctgcagaggccagaaaagcatgggacccagaggttggcatttgggctaaagctcatactcagagccatgtgcagggccaaacaggtgatgaaaaatgagagcactgggctggacccaggctgaactcaggaacaggcagcagcaacaaatttccagtaatgagagtctgccagggacacagcactgtcactttcctcctgccacctcaagagttaagcctagggacagctgcaggtctcagtgcccacagcagcaccccagaactacattccaaagaggggatcagagaggaagcactttggttttttacacagctcctatttatgtgttcttatgacatgcactgtcctgttttcatggttttgttgaagttccaggtagaatgggctaaatgcacattaagactgaaaacagaatgttaaatggcatcatagacatattagaaaaggagggcttagagattacctgagtcaaccttgtgtgaaaactgagaaaaatgagaccctaacaatgttatatggtaggctgcaaaggctggctttgggtcccagaagaaaatatgcgtgtctgtgtgtgtgtgtgtgtgtgtgtgtgtgtgtgttgcttgtgtgtgtgtatagatgtgtgtatgtgggtatatgtgtgtgtgtatatatatatgtatatacagagagagtatataaggtgaatatgtacatttgcatttatatataaatatataaatacacaaatataaatatataaggtatatatatacacacataaggtgtgtgtgtggatgcatatatatgtgtgcatatatatgtatatgcagagagagcgtatatgaggtgaataggtacatttgtatttatatgtaaatatataaggtatatatatatacacataaggtatgtgtgggggtatatatgtgagtgcatatatatgtaacatatgtatatatatacacagagtatataaggtatatatatatatacatatgttagtatgtaaggtatatatatggtgtatatatatgtatatatataatatatgtatatttacagagagtaaggtgaatatgtatatataaatatataaggtatatgtgtgtgtgtgtatatatatatatatatatggtgtgtgtgtgcgcatgtgtgtgtatccggatttgctactgtctaatgaataaacaagatccagatttgaaacacaatagtgtatatgaatgttatcagaaaaagcccatcaaatttctcccacactggggcactgcagagtccttcccttctcgaatgttctccctggcacttgtgtttctctccttcctgacctctgcctagtcgcagatagagatgcattttgacagaaccgggaagagttgttctatttccatggcaacgtcaattcacattctgcaggtacattggccgccactgcctaaatgaaggctcctcaaggctctgtgtgttgccgtgcctggccaaaaataactgggcatgccaccgttcctcacagccccatggagagaggcattaaactgactggatgccaactgtcaactctgttcctgtcttcctgctaaagaggaagaaacaggaactgccagtgttttgggggaggggagccagggaggctgctacattgtttccatggtctgagaaacatcgcatttcctctgttgaatggaacatgaaatacattcttacttgttcaccccaggggcaccagataatttgtatttcagcagaagtattataattacatagtttagagttagaattaattagcatttggggaagtagtgataaaaccaagcagttattaaaaaaattaattttaatagaggtcagtttggagagagtgcttggttttcttttgaaagatttgtgtgtgtgtgtgtgtatggtgggggagataaaagaataaaattattaaatgatcctttaatcagtctgaaatgtgaactaccttatcattagacgctaccactggatgttaaaatccaaattagtggcacacatgcagaacatatttcaaaattagtcaagagttaggtgaatctttgagggttatctatgaaaaaaaaagaaagttttgtagagtcctttaaaaagtatatcatgttcccaagaatgtgggtcataacaaccttcttgacgttaaacatagtcaagaatgatttcatgtattatactagacacatgagatacttcataataattaaatattgtttgaagaataatttttgaaatcagttaacattgcctacgagtgcgctgagtgtgaagctctcctgggagggcttgtgcacccgggaataaagttgaatctttgccctcatgaggcttttactttgttttgagtgaggagtcagaaaagactgcaatttttaagagtatttttaccttcaattggagttttacaacactcctctaagttcttaaaatcaaagaccatcacagttaaattttaatttttttctgaaattgatcaccgttccgtggttgtataaaagactgtccttgttctcagaagataatgttgaaacctttggggagaaagagacatcatgtatgcagtttactctccaattgttcagcagtaacaataagtgttttcattagaatgagagaaagggaaagcagtggagaaaatgaggcaacttgttatcaagtggtgagtggaagtggaaggtatgctacagttactgtactattcgtataactgttccttcgtttatatatttttttcaaaacaataagttaatgtagtctatagctttaggcaaaaactctttttcaaggaaaaggagcagtgtgcaaaagttatttttattttttcttaaatgaattcgcagtctttttgaaaatctggaacgtcaacacttgtaaatgtatacttctttagttttcagattatagtaggaattaccctactaatattctgaaataagaagtagcctttactgatgtaccaatatttttaagcagtgccagtttctaagtaatcttttcttaacttcgcttctgaaaatttgaaaaatgtcctttcgtcacaagctataggctgcattagtttagcttttccttttccttccaagacaacacccttgccgcagtttggggccagaatgatcagctgacccattccacatctttatactctaaatcaaagttgttccctttaaagagctcattggagaggaatatgtgggatttgataagctccgttgatggtttaataattatgaatgtttaacagacattatacatttatcccacatttactagtataagagcgaaaataaggaatgaaagcaaattgttctgcagggtccatttgtgcatgctattatgccccataaagaaaaaaaatctttcataaaggatcgttagttttttcatcttatttacaccattagatgttgctgcagaacattagaatatgcactggtgcaacgtgaatagtctgtctgctatttattgcataatccattttatgcaatgtcaaaaaggaaaacaaccaaaaatacagggtttattttaaattaggagttaagctctgactttctgatgtgctaagttgaagcctggagcattttctcgctaatccagtgtgagtttctaacagtgagccctgttttaagaggaaaaagggtgatgtagtccaattaataagatggccttgttcattttccctgggatgatgaagcattggatggctccctggctcagtgaaaacagggtggaaaaacgttgatccaggaattgtaaattgagcatgcagggctctgcaacagctttcctatacttctttgggaataaggagtagggttcaccatacctgtccagttttctttgcacttgccactgtttctcttaaattgttttgggaggttgctttcattttggcacatttttgacgaaaaatgtgtgccttcaagttcatgcccaggttgtctgtcctgatcacacaaatggccttggaggttccttatgaattctgtatgcaatctgtcactgcattgcttatgtagcagttttgagtgcaaagccttgaaaattaatgaagtgcctttctgttttctgtcccaatctgtgatctggtgcctggagggtattttgactatttttgacttcacttgtttttgttgttgttgttgttgttacatacagtttttttatttttaaattctctctctaatatgttattttgcttttattctgtccattcattcaacaccatgttgacatagtttggatatttgtccctacaaatctcatattgaaatttggcccctaatgttgaaggtggggcatagtggaaggtgtttgggtcatggggaaagattcctcatgtatagcttggtgccgtccctgtgataatgagcgagttctttttctactagtttatgcaagagctggctatttaagagagcctgacacttcctgccatcactcttgctccttctctggttgggtgacccacctgctcccttttcaccttccaccatgatttgaagctccctgaggcactcaccagaagcagatgttggtgccatgcttcttgtacaacctacagaaccataagccaaatcaatcttttctttgtaaattatccagcctcatgtattcccttacagcagcaccaaacagactaagacatatatgcatagttgtgttcttagattttgttgttgttgttcccaagatagattttcctttctttttttcttttctgttctccatgtctcttcattcatattacagatgaggcacaggacctgggctgaagtatgtacggggtaggtaggttatgttctctcctctttctatgcagtcgatgtaagaatcccagcactttgggaggccaaggcgggcggattacccgaggtcgggagttcaagaccagcctgaccaacatggagaaacaccgtctctactaaaaatacaacaaattagcagggcgtggtggcacgtgcctgtaataccagctacacgggaggctgaggtaggagaatcgcttgaatacgggaggcggaggttgcggtgagcagagattgcaccattgcactccagcctgggcaacaagagtgaaactctgtctcaaaaaataaataaataaataaaaataaaaattagtggaggaaatgggcaagcgtcgaagctgagaattttctatggtcccttccctcccctgcagttctgggaatggccactagggacgcagttgtgccgttaatgggtctcgggggaggccttgcccaggtgtgaacgagggaggtcagagcactgttactcttatggcgcataactatacagtactataactttactatgataacttcactgagcaacggtacaaatcgacaaatggacaacagtttctatcattgattaatcaaataatcagaagtcaataatctgctaagaatattctgacctctactggcccttggcaatagatggagacagaacaatgccgcaaacgtgaagacagcctcccactctctcctctcccacttctcctacaggctttgaggatcaccacgtttcgctccttcattcacatgtctctgacattttagagtccagaacatcacaagatacccataatttccaatgacgtgaagtaatagagataagatttagtaggagagtaaacctacctctgtccttgctgttgtatccccagtgtgcagtggggtgacttcccagagtaggtgtgaagtcagtgtttgtggaataacagatatgaaagaaaatagactcagttttgtaagaaagaacaaggttcactcaggataagatgggcaagggaatttcttcttatgtgtaatcgctgaatcatgcataattggaagggaaagatcactgctacgttaatttcctcctgcaaacacacacactctcttcttgcaaaacagtgtaacctatctcccttgcctttctcattggagaaagctttttgcatgcaagtgtttcccccaaaagcaagacctcaaatagaatacttttttttttttttttttttgagacagagtctcactctgtcgcccaggctggagtgcagtggcgcgatctcggctcactgcaagctccagctcccggattcgcgccattctcctgcctcagcctccctagtagctgggactacaggcgcctgccaccacgcccggctaattttttgtatttttaatagagacggggtttcactgggttagccagaatggtctcgatctcctgacctcatgatccacccgcctcggcctcccaaagtgctgggattacaggcgtgagccaccgcgcccggccgagaatactttttgtaggttggtgaaagagtgacttatgtataggcagaggtgcaaagagagtgttttactggaagtgcagggttgtaactttactctataaagaattataaaatttgtagactcatgaatattagaactgaaaacaacattagtgattctagtttcatcttttccatgtttgtagtcaaggaaaccttttctttggagaaatgataaagttaaccacaatcacattcattttgaatatttttgttattaagtaacatatgctaaatttatgacatttgttttcaataagagctgtgacatggatactctaatcaagaaattaatgtaataacttacattaagctgaatttcttgtatttaaaattttatctatatgtgaatatatttttaatgtcactttttatcagccctgttaacttgagggctgtggcaaaattcctatttctttatctataaaataaggatagtatcatatctgttctgctttcctcttttctcaaaagtaactgagaaaatgtgaaagcattttatgaactataaagcaacataccatgaagagaattaaacaaatgaatataattttattattctcccaaataaatccaacctttattattaacacatatgtgaacagtgcaaaaacaagtctgatacattttttaaaggtcaggaattttgtagaatttttaaactataaaagaaacatgacatgattttctcaaacataaatttcttgcttttattctaatacgtaaataagcacaatactgataacctatgggtcagatctggcaggcttccaaattaacccatctggcagaagtcttgtgattcatggcaacatgcggtccctgggtagggtcttatcaggagttctccaattgttggcatactgtttactatgtaacttacagacactgaaaaggatcctgatttgtttcagaatgggaagaaagtctggctgatggtcttgcacatggacactttaacctgtatgttgccatctgtagccaatgattgtaacttctgtaatgtaccctccaatgaaaaaggacagctctggtgtgaggagttctcttccttctaaactttcttatagaggccttccaactcctagctgactctggaacacacccaacttctgttgacttcctgagtcaatcttcacatttagttttcaataaacctttgtcaatcgtcacgtttgatttcgaacaaatgtttatcaaaccattatcaaacctcaacagtcttaattttggtcaacaatactaacattttgagcaacttattatttaaaaattgatgtatattaattcctaaaaggtggacttattacaatgtaacaaccagtcatatctaaaatgccactagaaaattcctcataaaaatgctatctctgttgaattaataaattttcccttcaatttcatagtcttttttttagaagcctagcctatatagtgtttatttctatattggacctggctatactcattagtgattttatagtgctttctttgttatttattttagagtgctttggggggggacaattttagattctttttttatgagatggagtctcgctctgtcaccaggctggagtgcagtggggcgatctcagctgactgcaaacctgtgcctcctgggttcaagtgattctcctgcctcagcctcctgagtagctgggactacagttgtgtgccaccacgcctggctaattttttgtatatttagtagagacggggtttcactgtgttagccaggatgatctccatctcttgaactcgtgatccgcctgcctcggcctcccaaaatgctgggattatagccatgagccacctcacccagcctagattcttttagagaaagatcaaagcatgtgtaataaagtttgctttctgttctagttttgtttggtttcagaatgcatgtataaaatttttataacttcacagagtaggatggcattgtgcttgggcctcgttcctgttttttaatgtgattacatatgagttctttcatagaaattttactagctagtggtcactgtgtgtgaaatgctgcttattgactgggtccatgtctgtgtctggttttcctcatcattctgaacccactgcatattggcatttgccagtggggtgaaagtactgtacaggccttttggaaaaccaggctcaggccccaggctctgagtgagaggaacaatggggagctgtcatcccctcacctcctcccagtgaaaaatagaaaatcaaatctcctttggccacttggcaaggatctagccgttatttctccagtgtaaaagaaaagggtcttggaaaaagaccctttgctaatcaatatacgagtaggaaagattagagaggtttgacatcttgggcattaggattcactgcctgaactccttttgaattctactttgttttattttcttggaatttatggctgcaaatgactgtgctcttggaaactgagggcctgatgaaagttcttcccttgcttgtgtaacaagtgacactcacggactgacatcaacttccaaaaatatgcagaattttagagaaaaaaaccaactgcacaagttgcaattttgtacaaagaggaaacaacaataactttgtgttttaggtattagggagctcatccatgttcaggccattttaccaaatttaaaatttttaataaccaaaattttaccttagaaatgtagcattttgccatcattccttttgtcaaaatgttgtttttctggctggacacaatggctcatgcctgtaatcccagcactttgggaggctaggcaggaggattacttgaggccagaagtttgagaccagcctgggcaacataaagagaccttgtctctataaaaaagtaaaaaaaaaaaaaaaaaaaaaaaaaaatatatatatatatatatatatatatatatatatatatatatatatatatttgccgggtgtggtggtttgcacctgtggtctgagtgactcaagaggctgaggtaggtggttcccttgagcccaggagtttgaggctactgagagcgatgactgcaccgctgcattccagtctggtcgacagggcaagactctatctttaaataataataatgatgataacaacaacagcaatactaattttaaaatgttgtttgtctccatatttaaatgccaaactgtttagttaacatttttaatttgatttcaattaacctatgcttgggatctttttaccattacaatttgcatttgaaatacataatagagttattctaataatccaaaaacagacttttgagatcttttcccttctctttttgatttataaatagcatattgattcccatttaaagtgtgggtgcagtgtggctgtcagcatattccattttagtaatttcattattgatttatttcttttctaaaagttacaaaagcaatggtgatttgctttcgcaaatagaagtgactcagaatggtaaatactcacagttcatggtttcttccctgcctgacagtgtgagtcagaaattaaataaatcagtgttgaaattcctagaatggaatctgctgggacccacactgcgtccatactccatccccttctctacaaccagattaaacatactctctccatgtagggtggctccacttaggaaaataaaagtgactcaactgtacccatttttccacaggtacatttagcaaataccggtgggttttggttacaaaggtccagggattggtgctctaggagagcagttcaggaaaagggtctgtatgcaggagtggaggggcgagggggtacagagaaagctgctctgtgataggctgtccagagggcagctccaacagtctcctgtgaatgtaagttatttttatttatacatttatttttttgagacagagtcttgctgtgctctgtcacccaggctgtagtgcagtggcatgatcactgcaacctccaccttccaggctcaagagatcctcctgcctcagcctcccgagtagctgggactacaggtgcacaacaccgtgcccagctaacttttgtgttttttgtagagaggggtttcaccatgttccccaggctggtctcaaactcctgagctcgagtgatccgcccacctcagcctcctaaagtgcagagattacaggtgtgagtcaccacatccagctgtagatgcaagttatattcacaaatgtaagatggacattagagtacgtgatttgcctgctatagaaatacagcagtgtgtatgtaaagttgtaaatgccgtattttttacccgtaagacaaatagaagagctatatgctttaatgatgcataggactattttctgaaatctgctactggtgttgaatagttgcggctgtttttttaaatttatttttattattattatttttgagatgtattctagctctgccacccaggctggagtacagtgacgtgatctcggctcactgcaacctctgcctccagggtttaagcaattctcctgcctcagcttcccgagtagctgggattacaggtgtgtgccaccatgcctggctaatttttgtatttttagtagagatgggttttcaccatgttggtcaggctggtctctaactcctcaccttgcgatctgcctgcctcggcctcccacagtgctgggattacaggcgtgagccgctgggcctggccaagttgtggctgttattttaacatagaaagtttttttccaatcaaagtgtaacttctctgataatatgctttgtatttgtgatttatgttttagtaatagtagggcaaaatatttttttcctcttttgattaccactagaccaatattttttgtattatatttaaagttgatattttggtaacacaataagataaaatatatctttttccctttataaccaccaatctgatgtttccaatgtaacagttttaaaaacgcttcttcctggatatacctagtgattcctgaattctcttactgcagcctaacgactgttactcgctctttgctttaaataatcttgacacatagtcctcatcacagatccacattttctttggccatatatacaaactcgacagtgtggtgttggaaatgtgaaagggctgctaactctcctgaatctggggtcactggttatcaaataccatttaagcactttatatctgaattaagccgattttgtttgagccacttgatttttccaatgaagcaagaaggagcaaataagtggtaaaaacaaccttggcttgttttacttttcctccgtgaagtcagtgagtccggggctcccactggtatttttcatgttcatcatggacgtcccaggcagtagcacattctgagaaatggcatctaacctttcaaattgaagattttatttgctagaatattcactctttattgcttatctcaaaatcaggtgggatgagtgtcattactgtcccctcgtgcatgggcttcagatcagttgatagctaagcctagccgatgctcattcatctttgagattaacagagtagcttataaaatgcgttacacatttttgaaatgcaagcatgaagtgcgttagtaaaaaagttccttcagtaaatctttaagaatctggaaaaaagcacaagtcagtttaagagtatcatatccgtggttcactttgcagcagtgactttatatcttgttttgtgtgtgtgtggttctttgcatcattttgaacattttcttgaatgaaaatgagtcagatacagctactttgcttgtctcctgtagacacacactttgattaatagagttgttggcgaagtgttaaaagtcaagaatgttgttatcaccacacacagagggactggatatggggagtgtagtgggattttaaatgagaagcactgcatatcacaatcatagagtaactcctcgagtgattttacgtgatgagccgagcttccccaaagagtaatttaattggcatatttgaagctagaagtttctgacagccaccctgtaccttagcaacagcctgttctcttagtaagagtccctgtaaacaggtgggaaaattaaggcactccaaatgtttatcaagtgtaggacattcattatagtatttaccttttagagatatgtctgaaattccataagacagtttaagcaagccaccagctgttgtaaagggactgagaaagctctgactagtagacttcttcttagaatttaccagactttttttttttctcagaatgctgtgaatcataagactttcactaaactttcctattcttatcaaacagcaaataaactggctaaaaataactggaagaaatcttttagcatgtaacaatactcaactacatggaaataactctatcctgttttcctttgtaaaactgcaacaacaaaaaaattgtcattttcaaactgtgctgaatctctggcagtttttgaacccagctgcctgtcacggtttgagtctctgtactgtgtgagtgatgataggctaaatccacttccactgatttttctaactcattctcaaagttgtcttaaggctttcccattatttccaattacctgtgaaaaatgggcaaccaggaggtgggacacagtaccacaaaaccaagtcattgataggctcttaccttccacctggtggtggcctcagtcttcctttgaatcttctgagtaacatagcaccagagaaccatataaacagcccttgatttccagcctcagaggcagacatgagagctggtatgacagtcaactcttactatatcttatctgtatactatacaaataagggaataaatacaaataaaaagatttttttctgataataaagtaatgcatgtttccactggatagtcttaaaactgcaaatagttactgagaaaataaataaaatgcacttgcagtttcacccccagagatccataatcaggtcctctgtattgaaccattcaagggggagtccaggttccattggaacacaggatggatagcggccccagaagttgcacagctcgggtcttaaacagctgttaacatcttgtgtcacgcattatttgagcctttcgcatcgcctatgtagtttttctgttgttcttctttttttattttgctttctaaaacgagtgtcatgccatgctgacaggttaaagcttgttgtatcctgtatattttaatgtaatgcccgctaaccacagtattccacatcgagaattctgttctcagtgacaggtggactgttctcccgagggagggctgaggcaggaggaagtactcagacttagagaaggcatggagaacagggaaggcagggacagctgtgtgccccgtggccatcaccattgctgggacctgattcttgatgccctcctggctgaggagtcggccaacatccctggtacagacttggtgttattgagtgataaacaaatcctcttcctcctctctcctcgccccactcttttcttcctcttttctcttcttttctcctcccctcttctttcctcttctcttctctttcctttccttcaatgttctaagcctcagactgttcatttctagagctggccagatagaacagtgagtcacggtgagatattgtgtcccatggatttgttctaccagaaacgtttatgagccactgttggggagctctggtgctcttttgaaatatccaatagcatctttctgatgaaagcctggaagagaggttccactagtcagtgaactagcagaaatgaccaactacaatgataacccatgaccatcaattcacagtggctgtaaatcagtgccaattcagacctgaattaccaggtcaaatacggttccaagttgcacagtgaagatactatccagccaaaactaaaaccaaaaccaaatcaaacaaatacatgaaaatcagagctagatcttaatctttgtggcttgagaaatccagagaaaataggaccctgggtaagccctgaaattaaagagacgaatgttaatgacttaaagatttgtgttccagatcttcagtgtatttttgtttgagagttcttgtagctacctgaggtaaggtaacccactgaaaatcagcggatgtgcagcgtgaagttggcatctgacagctccttgatagcactgccacctgctcacttgctcattctagctacaacagttggtgggagaaacatgtgctagtcttgttataagtgcatgttaataaagttttctctgataatgcaggaaagctggggacagaggtagctagagtttgtttttcaaagataacatttctagtctggtcagatgcatccataagagggggaataaacagtgtaggctgatactcatctggtactaatatcctcttggtcgaagcatatcaggcggtgagtgaatacagggcaatgctcgaagaagacttgaagcatgggagcctcagctccaaggtcggtggagcgctctttgaatttagccctgcaacccatcagcagtgtggcctttggcagatcactctccaaaccctggtttcttcttctgtaaaagtagcataatagatattcttaatgcgtaacgttgggaagtaggaagtaaagagaacatatgcaagtgactttgtagcagatatttccttaaaggaatgctatggttctaattgtcagcatcactgtcgcaaatgagacgttcttaacctgctgtgtgccgtagagctctctggcaaactcatggagcccatggaactctcctcaggatagttttgttaaataaaaaaaattatacataatattataaaggaaatcatttagcaaattattactaatatatatgttaggcagaattatgactccccaaaaatgcctgtggcttagttgccagacctgtgaatatgttatgtcctatggcaaggggaaattaaaggtggagatagaattaagtttgctactcagctgtccttgacataagaaaattattgtggattatctgggtgagtccaatgtcatgacaagagtccttaaaagtagaaggaagagacgggagaacccgtgtcagagtgatgcaatgggaaactcgatgggccattgctggctttgaagatggaaggagaccatgaaccgaggggtttgggcagcctctagacattggaaaaaataagaaaatagattctccccttgagcctgtagaaagaagacggcctgccaaccccttgcttttagcccagcttgacccattttggatttatggcctacagaactatagataataccttggtattcttttatgtcatcaagtttgtggcgatttgttacagcagcaatagtaaactaatacagttatcaaattagataaaatccatgatgtatgatatgttcttcttgattaatttattaaatgacacactagatttgtgtccatagcaaattttaagaagttattagtgtcaataaaaatgtatagagagctatatctgaaatgtgattttgaaaatattagtaatttttattgatgatgaagtcacagtactaatactactgtggtttgttgcctatattaataattttaaaacatgataaatttcagttagaggttagtgaaaaatagaacaaatgttttcctatacccagcttcagggagcttcctgaattttatgcatagagggtatgcaggccccagattaagagtccctggtttagatatatgaaagaatgagaaaccttctaagttcttcaagatatatacaattcaaaagcaaaattagaaaatcactgcagccggaaagaacattaataatccattagccggcgctgtggctcacgcctataatcccagcactttgggaggccaaggtgggggtggatcacctgaggtcgggagttccggaccagcctgaccaacatggtgaaaccctgtctctactaaaaatacaaaaattagctgggcatggtggtgcatgcctgtaatctcagctactctggaggctgagacaggagaatcgcttgaacccgggaggcggaggttgctgtgagcagagatcgtgccattgcacttcagcctgggcaacaagagcaaaactccatctcaaaacaaaaaataaaagaatacgaagcttaatgcctttaaaaatttattctcatgagaaaagaggcagctcatggatgacctcagtgaaatcagtacattctctgtggagacagtctttatatatcacaatgaataaaagtagggagcataatttttaaaaatggaggactcaagacacagattgaaaaggggagcacaaatataaagctcacaggaataatactaaatataacacacctgggtagaaacgcatcatttcctctagtgtttgggacagaagtaataacaatacttcaaatatgtatttgaagaatatatattttaatatacaaagaggtgaggttgtcacataaaatagaggatgcccagttcaatttgaattcctgataaacaaaacataatatttagtgtgagtatattccaaatattgtgtggagcatacttatcctaaaaattatgcattatgtaactaacatttagattgaaatggtgtcctgtattagctaaatatggtaaccctgctgagaagagactactaattctacctttaggctgtatgaagtaatatttgcagtaatagatattgtttggagtatctctgcaatgaaattctctttgagcttgctctctttaaaaagagaagcctcgtgctgcatacctaccatattgcctctccaagcccactctttccctgtcttcaccctgctctgagccccaggaggctggctgcctcaatgggctcccaggtcatgggcttcctaccaggttccacaatgggaggcatcagcaggagactatagggcagaagagcagtatcgttagagagttgattttgtttcacctgctccttcccattcaggttgctctgaaaccactcctgcccactaaccctccatgcctagggaagatgacagttttgagctgctcttagcccctgggtactgcactggctttgtaaattgcccctttattaatgattgagcttgaaggtgccatctcttcccttctggagctttaatatgctgaagaatatgatgtagatctccaaggtcaagagtaccgtctgcatccatgaagctgtgaattagaaaaagaaaagtaagatttggaaagaaaatagttaagttgacattcaatagtgaggtcttgctggtcacttaatctctcttttaaaacagatatttattcctggaaggtttctggaaaaattaatagaagcaggagtcttaatcagttgaaagacataaagacatagactacagaaataagcagtttattactagaatgtctatgttactcataaaacaagacataaatcctgtatttatgaaatatatgtatttaaagggctttcttcagaaaacttaaaaaacaaaatatttagaaactatttcataaatatttaggaaaaaggcaaaaagaagcaaatcatgtgttgtcctgagacttttttcctgcaatctcccttttctcctcctccctcccagtactgctgaagttttcttcctaaagaagggtactcagccgggcgcagtggctcacgcctgacgcctgtaatctcagcactttgggagaccgaggcaggtggatcgtgaggtcaggagatcgagaccatcctagccaacatggtgaaaccctgtctctactaaaaatacaaaaattagccaggtgtggtggtgggtgtctgtagtcccagctactcaggaggctgaggcaagagaatcacttgaacccaggaggcaaagattgcagtgagccgagatcgcatcactacactccatcctgggtgacagagtgagacactgtctccaaaagaaaaagaaaaagaaaaaaagaagggtgctcagatcttcacctccagcacagacacttggatgacttccttctatgcatctgagaagttttcaaaaaatatttgctaaatttaattgcatttctgcttctttaacccaactgtcttagatatggtttggaaaagagcaagagaaaagtaaagttaaattccctaattatttcttaaactttccccagaaacttaatgggcacgttggatcatagtttgtcccacatagtaaatgagacacatgcgttgctggtgagtgccttcttaaataagaacagagatctttcatctagaggctggcacagattggaaggttctggctgctatcatcctatatgtagtagagttttggtttttttgtttgctttaatctgaatgtctgattgaggtattcaaagagcaagagagaaacctgtgaagagatggactatttgtgtcagaactgtttaatcttgtggctaggatcacttgtattgttgagctagattcctcaatagctgtctagatatttgacatatggtgttttactctattgtggtatatgaccacataaacagataaaatagtagtaatcttttcaatcttttatagtctgcaagtattcatacacttatttcaaagtagtctgtttctagcttaggtaaatttagatgatttcattgaatactgtattaaaaacctgcttcattccagttaatttttttcaggaattattactcatactacaaggcattatttatagctccagctctcttacatgataaagaatgagctgcgtattacattgctataatgagaaattctcttgtgtttaaattaatctcccttcttagcattgagaaattctgtggattctaaaattctatttgagaattgtaagaatgttttattactctcttataatatgtaccatattttttctctcatatatctgtcagtgatgggtatatatatatatatatatatatatatatatatatatacacacccatatatatatatacacccatatatatatatatatatatacacacacccatatatatatacacccatatatatatatctatatatatatatatatatatatatatatgggtatatatatacacacacactatatatatatatatacatagtgcatatatacatattatatatatatacacatactgtatatatattcatgtttacataggtatatgtgaaatacatgtgcttataaatcctgaacaatgccaggcagctgtttttataatcttgctggtttatacagaagtcagtttctaccacctttcttccaatcctagggaagttgtctctaaaacacccatctacagcagaaagggaagcccatgggccagccactgtgtggttttttatacgcattgctttgtttagtcctcacagcagtcttgcagagcaggtgtggcgtattcccatttttagataatcaaactgaggctcactgaaatacagtgagctctttaaggttactcagctcgtaatggtgggtcattgttgccttcatatacaattgacaatagtaattcctcctggcaacaaaatgagatatgtcctgaactctcattgtgaaggaggcactgtgccaaacatttaagcagcccaatgacacagagttattattcccgttttataaatgaggaaaaccgagacacagaaaggttatgacatgtgcagattttgaaacccagatctaatgccaaaatccatactcttaacactttactatgcaacctaccatgtgctagactttgatgagtctgttggattatactcgaaatccagtacttcatatttcataattttagtggtttcaaaatccacgttattttgaccaattccaacatagcagttctcatagctggaaatacaagttagaaatcagcttccatttagtgatgcaaaactctgcaaaggcaaatgtatgcaagctgatctttatgaaaagcaatcccaattaactttattttttaaacaatttatttgtatattgacaaataaatgtatatatatttattgtgtacaacaggatgttttcttatatgtatacattggggaatggctaaattgagctaattaacctatgcattactgaatatacttatttttatgctcagaacacttcaaatttactctaagggcttttcaggaaaacaatatgttgttattaattgcagtcaccgtgttgtaggatagatttcttgaacttattctttctgtctgactgaaattttgtcgtctttgaccaacatctccccaactccccacccctgcccccacccctggaaaccaccattctactcactacttctatgaatttaattcttttagatttcacatatgagatcaagcagtgtttgtcatttgtgtctggcttattttacttaacataatgtccttcaagcttagccatgtttcaaatgacagaatttccttttttataaagctgaatattatttacttgtgtaaattttctttattcttctgttgacacttaggttgattctaatttttgtctattgtgaataatgctgcaatgaacatggaggtggagatatctcttcgatacgctgatttaattcacagcctttggatatagatccaacagtggaattactggataatatggtagttctatttttgattttttgaagaacctctatactgtttccaaaaatggctgtaccagtgtaaatttccaccaatagagtactagggttctctttgatacacatcctcaccaatacttattatcttttgtctttttgataacagccatctgataagtgtgaggtgacatctcattgtggttttaatttccattttgctgatgattaatgatgttgagcattttttcatgtatcgattggccttttgaatgtcctattttgagaaatgtctattcaggttctttggccattttttaattaggctatttgtttctttgctattgagctgtttgcattccttatatcttttagatattaatcccttatcagacatatggcttgaaaatatattctcttattccataggttctctttgctgattgtcttcattgctgtgcagaagctttttaagttgatataatcctagttgtctacgtttgttgcctgtgcttttagggtcacatactaaattcattgccaagatcaatattatggagcctttcccctgtatttacttcaagtcttatgtttaagtgtttaatccattttgagttgatttttgtatatggtgtgagataagggtctaatttcattcttctgcatgtggatattgttttcccagaaccatttatttaagattgttctttcctcaatgtgtgttcctggcacctttgttgaaaatctattgactgtaaatgtgtggatttgtttctgggctctttattctgtattctgtgcaactggtctgtgtgtctgtttctatgccagtaccatctgttttggttactgtagctttgtatatattttggaggcaagtagtgtgatgcttccaacttgttcttttgctcaagattgctttggctatttgggggtcttatggggtttcatatacattttatgctaatttttttctatttctttgaaaaatgccattttgatagggagtgcattgaatttgtagatcactttgggtaatatggacatcttaacaacattaattattccaatccataaacatagaatatttttcaatttgtattttcttaaatttcttttaacaatgtcgtagtttttagtgtacagatttttcacttccttggttaaacttattcctagatattttactattttttggcagctgtaaaaaatgagactattttcttgataacttttttggatagttcattgttagagtataaatattctactactttttatgtgttgattttgtattctgtaatttttttgtatttatctattagttctaatagttttatggtggagtatttagaattttctacataaaagatatgtagcctgcaaacagtgacaatttaacttcttttttttccaatttggatgtttttaattcctttctttttcctaatttctccagttaggacttccagagaagtagaacagaaaggacaagagtgggcatagttattttcttcctgatattagaggaaaactttcaatttttcatcattgtgtacaatgttagctttgggtttgtcacatatgccctttattgtattgagcaacattctttctatacctaatttgttgagaattttatcatgaaataattttgaattttctcaaaagccttttctgcatctattgagatgcacgtggttttccccttcattgtggtaatgtggtgcatcccatgtattgatttgcatgtattgaaccattcttccattctagggaccaatcgtactgatcaaggtgaatagcctttgtagtgcgctgttgaatttggtttgctaggatacgggcctgcaattttcttagagtgttcttgtctggctttggtatcagggtaatgctgaccttgttaaatgagttgcaagcttcacctcttagactttttaaaataatttggggaagattaggattagttcttcaatatttcatagaatttatcaatgaagccatcaggtcctggatttttccttgattagagtctttttactattgactcaatcttgttactcatctctgatctattcagattgttatattcatgattcagtcttggtaagttgtatgtgtctagatatttatctgtttttttatgttatccagtttgttggtgtataactgttcatattagctttttataatccttcgtatttctgttgtatcaggtgtaatgtttctccttttatttctgattttgtcttctttttttcttagtctagctaacgatttgttggttctatttttgaaaaaaaaaaacccaactttagttttgttgatcttttctattgtttttctagttctattttatttgtgtttgtactgacctttattatttcctcccttctaccaattatgggcttagtttgttctcctttttcttgttccttgaagtgtaactttaggttatttgaaatcatcttttttttttaatttaaaagtttttttgttaaaaacttctttattagaactacttttgctacatcctataagttttggcacactgtctctgttttcattagtctcaatgatattttagtacttaaaatttagacgtaaaaaatgacctattaatttcttctttgacccattgatcattcaggaacatgtttaatttccatgtatgtgtgaatcttccaaaatttctcctgttattgatttctagtttcataccattgtggttggaaaagatacctgatgtgatttcaatctccctagatttgttaagacttatggcctttcagtctatgcatgtccttaaatctgaagtgactgtcttacaagcagcacatagttgggtcatgttgtgttctttttaaatccacttatccactctttgtctttttgttgtaaaatttaatccatttacattcaaggtaattgtaaataggtaaggacttattagtgtcactttgttactggctttctggttgttttgtagatcctttgtttctttcttcctctcttgctgtcttcctttgtgattaggtgattttgtttagtggtgtgctttgatcctttactttttatctttgtgtgtctactataggtttttgctttatgattaccatgaggattacataggtggcttatatttataacaggctattttaagctactaatgacataactttaattgcatacaaaggctacactttcacttcgcccaacagtttatatatatatgtatatatatgtatatatttttttttttttttttgagatggagttttgctcttgttgcccaagctggagtgcaatggcacgatcttgactcactgcaacctttgcctctcgggttcaagtgattctcctgcctcagcttcccgagtagctgggattacaggcacgtgccaccatgcccagctaattttttgtatttttagtagaaacagggtttcaccatgttagccaggctggtctcgaactcctgacctcaggggatccacctgcctcggcctcctaaagtgctgggattacaggtgtgagccaccatgcccagccagttttctatttttgatgtcacaatttggatcttttaatattgcatatttcttaacaaattgttgtagctaatattatttttaatggttttgtctttgaaccttcatactaaagatataagcaatttacatactaccattacagtattagagtatacttaatttgaccatttacttacttagactgagttttaactttcatatattttcgtgttgtttattaatgttctttcagcctgtagagctccctttagtgtttcttgtaaaaggggtctgctggtgatgaactacttcagctttatgttttcctgggacaatttttattcttcctttatttctcctaataataagctaatatttaaaaatgtaaaattttgacattaaaaatataagtgttggcaagagtaaaagtatagagattttgtatacaattaaagttatgtccttttctgaaggacaggtttgttgaattggcagttttttctttcagcattctgcatgtatcatcccacctcctcctggtttgtaaggtttcttctgaggaatctgctgctagctttattggaacccctttatttttgattcacttattttctcttgctgttttcaggctcctctctttgtctttgatttttgatagtttgattatagcatgtcttggtgtagtcttgcttgcattgaatctgattgaaaattttgacttttctgtacctgtatatttatacctttccctagatttggaaagttttatactattagttttttaagtaagtgttctacctcttagtcttcctcttctttgcctcaaactcctgtaatgcaaagatttgctttcttgaattggtcatataattccatgtatactttcttcaaattttctcattctttctttttttctgttctaattatataatttcttctttaagttcacagattctttcttctgccttatcaggtctactgttgatgacctttattgcatttttctgctcctcgattgtattttctagctccagaatttgcttttaaaaaaaaatgtcaatctcactgctaaatttctaatattgatcatttattgtttcctgatctcagtgaattgtttctctgtattttttgaagagttctgaggtttcttaaaaattttttgaattatttgtgagaaagatcataaatttctagttcctttagagttttattttatttctttggtcttggaatctgctctgggagtgtggtgggaagtcagcctgttctcaattagttcttttttcttatttttatataactggctaccaatgacctatattcaaatagaaagcaagccaatttcttaatttaagtggaacttatcctcattatctataatctatacctaataacacatgcattataaagtagaatttatcaaaggctctgaagcactagaataggattttttttttctaaagcaatggaaaaatcacttgatttatttgaaagatatttattggttacttattatactctggtcattattctaggtgtcttagatatttgagtgaacataacagacaaaagttttcctttatgggatttctgttgtgggaagaagggtactacatcaaacctaataaatatgtaaattacatagtatgatcaaatgttatgtgtagcatgtgtgaaagaaatgagacccccgggaaggggggttgggagtgatggcataggggttggcaatagtcagtgggggcaaaatgcttcaaacagggcttgctgagaaagtggcatccgaggaaatgcttaaaggaagggaagttgctggtgaaatgtatttagaggaagagcttttcaggcagagagagaagctaggcaaaggtcttagggcaggagtgtgactagcatgttgcagaaacagcacaaaggccagtgtgcctgggttgaatgaattgggtgtgggggtgtttatagaaggagggtaggtaggacagagaggaaatgggagacaggttacctggggtattgcagcccttggaatacccttgaatggtacagggtacttttgcatggatttgaacagagaatctaatttctgttttagcaactgcagcagttgctgaactgagaaaagacagaggtgactggagggtgggggtggcgtgcaacactagaaagaggcaggcctgcaagggaaaattgccagagtcccagcaatgcttgacaataagagaatcgtggcaaaaaggttaggcagaagcaatcactctctggtcatattttgcaggtagaataagtaggatttgttgacaatgtgaacaggagatatgagataaaaaaagagagcaattaccaataacctcccagaattttgccttattacctgtcaaagagaaaaatagatttttcactagaaagcatttatttttaaaaaagaataagagaacacatttgaagtgttcgtaattaaattaattttagactctaaaattgcactttcttttatgatatcgtaagacaaaatactttgaaattttacaaacatcttaaaacacgggggcagagactcacagattttataagctggtgaagttttatgtttgaattcctcatgtgcccaagtcacgtaaaagaataatggagctcatccatgtcatctgtagtttaaaaagtgaccttaaatctgttttaattaattattttgccaaagtttggcaattttagagaaagttgaagaatgatttttacactaatagaagtcagcaaaaatccccagtgacaaggaatccttgtgtgaatagagaatgctggtgtttatactgacacattttcatgtccatgagacagaaaccttgcaggacagtgggagagaatgtggggataaaaactaagcaaagaaagcacattaacaattggtcctcatcctaccaagtgccagaagctcctgcctgcactgccaaatggctctagacaacctctttgtgacgtcagggtgggggtactccagccagacctctctcaaatcttttctcaagaatgaggtggaagttaaacaaagacttcccaaccctaacctccttcctctcacatacccttacctgattcctgcatggagaggaggatggtatgtgatccatcagccacacagtgggaaagtaatatttcaacatccatgtaatgaaaatatactgtgtgaacctacatagtaagtaaaagaaattaaaatgtctagaatccaattatagattccatttttttaaaaaaatactgtatttattgtgtataacactgtccttagcaaatcacatagacctactgatatggtttggttctgtccccacccaaatctcattttgcattttatctcccataattcccacgtgtcatgggaggggcccggcaggaggtaattgaatcatgggggtgggtctttcctgggctgttctcatgataatgaataagtctcaggaaatctgatggttttataaaggggagttcccctgcacacgcactctcttgcctgctgccatgtaggacatgattctgcttctcatccaccttctgccatgattgtgtggcctccctagccatgtggaacagtgagtcagttaaacctcttgcctttataaattacccagtctctgatatgtctttattagcagcataagagcagactaacacacctacaaaatcttacgttgtatcctaactgaataatatatctttgatttttatttccatttccaaaatttaggggatggaagatgtcttagggttctctggagaaacagaaccaatggtacttatttttttttttttttttttttttttttgagacggagtctcgccctgtcgcccaggctggagtgcagtggcgggatctcggctcactgcaagctccgcctcccgggttcacgccattctcctgcctcagcctcccgagtagctgggactacaggcgcctgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcccttatttatatatagaagatatttattttaaggaattggccaacgtgattacggaggctgataaatccagaatctgcagggtgggccaagaggttggagaccttgagaagagcaaatgttgcagtttaagttcaaagtcagcaggggacccaggaaggaactgatgttccagtttgaaggccatcagcagaagaattattttgcttgagggagctcagtttcctgttccatttaggcctttaactgattggatgaggtcacccgcattagggagggcagtctgctttgctcagagtccactgactaaaatatcaatctcatccaaacacaccctcacagaaacacccagaataatgcttgactaaatgcctgggccccctgtggcctagctgatttgacatcaaattaaccatcacaaaattttcttttctttatgcaaattttatagcattacttttgtgttgtggttttttagaagcatagacctagagaatagtgcccatgacctctgactatcctattatacatgaggattgcatagtatggtagaatctcctataatattctttccacgtggctgcagaatctctgtgaattctctttgaaatcgctgtgaactctcttgaactcatttttgttggcttttggtggggaaataactagaatttaaattgtgtccagtaaaggtgattctggaaatgaagccaaggaaaaataaaccatttgcttaatctttcaaggggcacaataattggaaaagacaatagtgaaataaagctttttcttttcactgttcgagctataatatccctcccaggtgagaggtattctggctgtaattcccaagggaacccttgtcacagtggcgtctttagtgagatgatttgatttttaccttttttcctttgggtggatgcctttctcctcttcttgactgtgcatgtgtcactctgtgcccacggagacagaaaagaataaaaagcttacctctccccctgaaatgcagcagagtcaaacttcagagttcagcagtttctcattgaaactatcaggcaatctgatgcagaaagacaacctcagacatgactgagccttcaaatagaagtttccagagaccaaacgtctcttttcctggatccccgatatggagagaagccgtgatctccacagagacttccaagctctctggcatcactttagcagagcagcccttgctgcggaagcagaaactcagagaggaagggctttgctgctggggctcaacaaaggtgtccgtctccagccagccactgttccaggtgcggagtacagagagggcgacacactcatagagttggtaagttcattgagaatgggtgcataacaggaaaagttttgattaatgtggagccttaattcaaaatgtggtccctgaccagcaagatgagcatcaactgttagaaagacagaaacatcaacccctctctggatctcctgaaccagtgcctgtgttttcataagataccccagggatttgaatgtgccttagtttgcgaagtgccatctagagtgtacaagaaccagaatgtacataaatttgactctaatcaactggcaatggcctcttcactatgctggctacaactctcttctctctcctgtgctccttatctcagtgaatagcagaaccatctatgaaaactcatgccaaaaacctggatgtctccctggaaacagccctcaccctcaagcagcttcataggttctctctagaatgtttctagaagctgcccatcttcactgcctctcccctggttccgtctctaagattattaactttctcacgggcttccttgccttcaccctcagcccttccaatggattccccaccctgcagttatgctgattttgctaaaattcaaatcttctcatgtatccctctgctggaaatggttgagtagctctgattactctcagcatgaacccacatgacttggtgtgacttctacctctctaaggatgtggctccagcagccccctccagcctcacctcatgcaacacccaagcctgcctgagagacaatagcagtatgcttcactggtgaaatgttttatagctacctggagtgcttaccctctacgtgtgagcaggcagtctctctctctctctctctctctctctctctcacacacacacacacacacacacgcacgcacacacgcacacatgcacacacacagagagagagagagagagggagagaaagagagagagagagagttacaggttatagagagagggagaaagtgctttctcaccctgagattattccatgaacccatagataagtcagaaccaggaattacataaaaggcccatgaaaggttaaatttaaaggatcaaacctttgtgctaaagaccctgcttcaaacatgtggagttcctcatggtcttattctctgagtctgcatgttgttgttaccacctgcttacctggtgctcccagactgttagaagcagaaagtgagaccaagcagagttgctaaaggcaggcactgatgaccccatgccagcaggactggcacccaggaaggagcagaagtactctagggagccaagcaggagctcagcggaggccagggtgagggcaggtgtcctacaaatgtcaactccgatggtagctgatttcaagctctgtttgatgacagatgttgatcccagtggtttcaagcttgagccattcaaggaacattagaaactagaaaggaaatattgcataggttcttcaaatatcagtttaccccgtgaaaattcaagctttagtcctaatgcttaaacagtgctgtattaaggtctgtgtgcacttcaaggttaaaacctgaactgtaaaatatcattttttacagttatgggcccttttatgctacaaccccagaccccctgagggccttctcattccttccttctccttccccctccctcccctgccatcccctcctctcctctcctctctccttccctttcctcttttctttctctttttcttctttccttccttcctgcctgcctgcctgcctcttttacttgacatttattggtgagtaaatactccatgccaggatctgagtttacaatggttggtggctaggatggacagtctggagtcatctgaaaaaggacagtcaagaggggaaggaccagccagtataaaggctgtgagttgaaagtcatagagagagtagtggaaagaaaggcccaggataaaccatgccgggtgattatcccaagtcctggtgaatgcatttcatgtgctttgttgactgtgttactgtatattcactagcaactgagtggataggggtctctccttatagttgggtgatctgttagccatctatggctgacctctaggaatcagggagggtcttttgatgtgtaatttgaatattagctatatctcaggctttatttttgctgccctcagtttatagtacgtagttttgtaagctgccttaaaaacttttagacacaagcaagttaaaagaatatgcagtagatttaaatgaggctcctatttaaaaacatttaataaaagtaatggtgtaataattgtgttggtagtcaaaaggtaaatttcagactgtgtgtatatgtgtgaaaagtcagtgtgtatgtatgtgtatgtatatatgtgtgtatataaatatataataacatacaatataaaatatacatttgacacacaatttaagtatacaggtttaagatattttaaagttaaataacaaatagaaataacatatgcatgtaagtaacatctaaattgttctatttaagtatgtaatttataaaataaaattatttaaacttaaatacattttatttatttatttgttattggtggattcaaaaactactgatgattagccttctgtattagttccttctgtgtctggtagaaagtcagtgtgggccgggcgcggtggctcacgcctgtaatcccagcactttgggaggccgaggcgggcggatcacgaggtcaggagatggagaccatcctggctaacacggtgaaaccccgtctctactaaaaatacaaaaaattagccgggcgcggtggcgggcgcctgtagtcccagctactcgggaggctgaggcaggagaatggcgtgaacctgggaggcggagcttgcagtgagccgagatcgcgccactgcactcactccagcctgggcgacagcgaggctccgtctcaaaaaaaaaaaaaaaaaaaaagaaagaaagtcagtgtgatattgaaatatgtagagtggctgactgtgttttatttttggagggtggatgcaaagggggtagcagggagcttagtagcaagggacctcagtgagtcttgtgttgtcagtgaggccagaaattgatgtaggcggaggaactaaaacctagttcttcaattcctctgtataataacataatgagactctggaagcgtctctaaaagctgctggaggaagcttcaaggacatgcagatgagtggaaatgaaggagcaggagcaaagaaaggtgacctccatgacagagcaggaagctacaggctgggactgttggcgtcaccaaaacattctctgcaggagggatagacaagaacttatagatgacagcatctaccatttgattttaggattttttcagtctttgcgctgtgtggcaattgtcctcatcctacatctccctgtataaaacaggtaaccacagcagacttatgtcagcagcactttggggaatgagggagagagagttgcattttatgcttggcctcatgcaagctggagaaagaacagcagcttcaggagatgacgcagtggcaggaaccagaggaaaaaaaaccacccatgaacattatccaagagtttcttttttaggtgataaaatcatgagtttcatacaaatagcagatgaacattgagtcaaatattttatttaactcattcatgaatgagggaattgctaagatgttgcaactggttccattgaagattctatccacagagatttgttttctatggggcaaaatgtatttgcagcactgagaacaggagtcctttgccttgctatggacaggaagtgttttcattgctttatgttttctatcagttaacctctatctctgcagagttgtaaacagtcaagtcaaagacaagctaaggtatagataggatggatggatgaactggatagggcatttaatgcccacttactcaatttctgcccacttccacctttcacaattctgccggacaatatatttgagacggtgaaatattcgggaagcctctggacagacccataaatcgtagtctttggatgtggactttgtttataggtggggaacctgctgaagattagatgagtttgggtgggttgagacattctcgaaagcaagaaccttgtctaacatcttttgttgccgaggacctacatcctgccccgtagaattaacagttcgtaattattggccaatagccaaaatgtcaggattaaaattgcttacctctcagaaaaattaaaaatacttcctcagccttggtaaggaaagaagtgattaaacatctagagttttaactttctattaaaattttaaattggaaagaaccatagtcatagaaagcattcacagcaaactttaggaacacacaaaagacacgtgtgtaccagggagcccacgcacgtctgggtactattgttaaaatgagaagaactaggcacactaatctattccagggataggatgcttgaaatggacaaatagtaatctaggtttattaatgggtattcatagttgttaaaggaattatatataaataatttccaacaaacagcttaagaaattttaacttatgtttaattataacatgcctccgttatacaggaaaataaaaagaaaaaaattatcattgtgtaatcaggcaaaaacatcatggcttgttgatcctcacaataatattgttaggagaaatagctattaaagatataattcccatggtaatttcctgttgaaatgtttggccagtgacactaaaaccaagccaacttaaataaatatattgcccgtttaagttgatttcacttaaaaataacccacagtaatatcataaatgcctaaaaccatacttatccataataggtagctgttttttcctccttactattcaaatagattcgacatgaaatgaaagtaaaatctcacaatggtgaaagacttctggaaattttaaaatagatatttgctaatttgtaagtcctgcaagatcatgaggagtttgtgcttttctgcagatgcacctgcatgtttacttttcccattaaatgacatttcttctgtttctaatcttctagagatgcagaagaattgcgtgggacattttaaaatattagtcacaactaatttgtcatcaaattttgtgagatctttcactgacacagatgatcagtatataaaaagcaagtcaaatatactttaaaaaataattacatccacagcaccacaactctaccttaataaaaatttcacaattaggcgggctgtgtgtcattagcctccctgatagcattcagtgtattgtcacctcatgttcaagcacacatctgatagaagcaagacattctgccacctcattccaccttctctattttacacctttaaaagtgtggaggtagtgtgctaagagttataaattgtcttgctgaaattctttgggagaaaacatagggggcttccatataaaataaacagtgagactcaaaaattctagaatcaaacatttattgccctctgctgtcagggtccacctcctgggaatgtgtgttaccttttgctctaattctttttgaaatgtctccagagagtatgaaaatgtagtgatttctctggttttgattttcaaaaccaataaagtttttcctttagtccaatttttaaaacacaaaatgttttcaaagtatacccatgttgtagtgagtaaaaattctgaaaaattctctatattaaaaaataaaaataaaaaagttgagtctagaaggggcagagagcaaagaacagtgtgaaatatctacagatgacaaagacagtcattagctttattattttgggtgctaggcacgtgttttcaatgtagttatactctcccacagctataagggcataaagctacatgttagaaaaagtgcttctgacactacataagtgtacaatagctacgtttagaactgttcagtgtggtcatattttaaaattatgaaatgtagggaagaaatgcaattatgtgaataaaaagactggaaatggtcttcatttctatgcaaggatggccacaaaaaaggtgacatggagccattttcatgtacaaataaatgagaaataatctcacaaggaggtgagaggctgcacttgctcttccccccggagtggtgttgccatggtaattatagtgacttcagacacttctgagatttctggtttcacactcaactgggaacggcgaatcgcctctatgggtgacaggatccactttggatcaataagcagtgcacgtgtgttccgggtctagctctgcctttcatttgctgtagcttcataaattgctctgtccctcactcaactgtgacacgggtcctgtctgccactccgggttgttatggatggagagccaaaacgcagctgctcaggaagtaactaggcagtgcatgtgggttaggatggcaagatttagtctcatcatttgttgtttccacagttgaatatagttctggctttattatgaactttaaaaatcagaagaagaaaatcacactttcgtagtgttgttggattatttttggtcatttccactcatactgaaaaatgctgggtatttgagtccatttcattgttcctgagcaaggctttcctttgctcttgtgagcttttttttttttttttttttttggagacagagtcttgctctgtctctgttgcccaggctggagtgcagtggcatgatcttggctcactgcaagctctgccttctgggttcacgccattctctgcaagctttgcctcccgggttcatgccattctcctccctcagcctcccgagtagctgggactacaggcacccgccaccatgcctggctaatttttttgtattcttagtagagacggggtttcaccatgttagccgggatggtctcgatctcctgaccttgtgatctgtctgcttcggcctcccaaagtgctgggattacaggcgtgagctaccgcacccggcctgttcttgtggtctttctacaggaagtgacttttgctgcagggagcttctgttgggggaaaaatgaatttaatagttttgaaatagtgggttttaaaaagtgtatgcccaagtttatttgacttacagttttggaggctgagaagtccaaggtcaaagggccgcatctggtgcgggccttctagctgcagcatttcagggtgtagggcatcctaggcccagagggcaaaagcatggcctaaaagagttgtttttttcccagatgagaataaattgttaattctttcccaaatcagtaattttggtaggttgactaaaatgttttctgattgcatcagagaaaagatataaatattgatatttagagtgccttttgaccttgagccagtatcatctttaaggtccagttatgtgaaattcaaagtgtcagtgataatggccttcctaatgtacattctttactgtcacttaaactttctgcactcaaaaccatgtggcacatcgctgtttaatatgacagtccagcacgaggccttacattcacaaccttcagtagcaacagcgtcaaatttctatcatcaaaattgtagcatgtaaatatgtcacatgaagataggtttcaatacagaatgtacgtgagagataagtaatgtctacaaacattaaaaattcctcttgactatgtttcaagtttctagaaaatgaagtatgatatttgcaaaaatatagcttcaatgtgttatgcatagaacttaatgtgtgtgaggctatgaacaagactgtctcagtctctgacctgttatttgttcacactgagttcagatttttaaagggaagaataccaggagggaaagagcaatactctctcttccctaaaaggctttgggaaatgctttatctcatgtgttagtgattctttaacttttgtgtatacagccacatctagaaagagactatttccttttctaacaggagcctatagatttctaaaaggagcctaagtcagggcacaaggaactgcctctgggctgtgaggctggagcagcctttgaacaaggactcccagagaaatggcgtttgaccttcctctgcctcatttctggcgttcttgtttcttaatgttgggtgcaggcagtttctgtcacagctgactgagtttgggggtaaaatattgtggcacaatatttagttttgtttaattaaataaatgacatggtaaacaaatctcatacatgttgctatcatttacctggcacaaaagaccattagctgtgtgtgtgagtttgtgtgtgcgtacatgcatacgcatgtacacacacatatgtctgaaaataagattcaaaatatttacaacttatttttcttcactgctaggatattcatttttactgctgacagatttttaaaaatcatgtcagtccatgtggagaatcccatgtgatatggtctggctgtgtccccacccaaatctcatcttgaattgagctcccataatcccctcgtgttgtgagagggacccagtgggaggtaattgaatcatgggggcaggtttacccatgctgttctcgtgatagtgaataagtgtaatgagatctgatagttttataaagggaagttcccctgcacactttctcttgcctgctgccatgtaagacatgcctttgctcctcctttgccttctgccatgattgtgaggcctccccagccatgtggaactgagtcaattaaaactctttcctttataaattacccaatcttggatatttcttcataggagtatgaaaatggactaatacatatgtgagatgtttctaaggggactaaggaattaagcatatcagaaaacatagatgagcagatgttacccctgcaccgttaatgatgatgatgattgtgtacttccctgagcagatggaagcactgggctttatagggtagtaagagctgagtttcatgtccaatggacctgagtggtgagtggctttttcatcttggttaaattactcatggccatgtctctggcttcatcacatttaattgaggacaataatagaatttataggattacttagacgttgaaatgcctcattgcaatgaagcacttagcacagcacctggcacataggtgggcttctgttcttacagcattcttcccccttatctgcagctccactttctgcagtttgagttttccttgatcaaccatggtctgaaaatacatgagtgcagtacagtaagatgtttagagagagagagaccaaattcacataactcagaatacagtatattgttttaattgttctattttattattatttattgttgttaatatcttactatgtctaattttataaattaaactttgtcacaggtgtggatgtatagaaaaaaacaaagcatataaaggattcagtactatccgaagtttcaggcatccattgggggtcttggaagctgtgtataaggcagggctactgtatttgttattttgttgcagtcattgtaattagttgtagttgtggtagtagcagtaataacagtagtgatcattgttagatttatagttctttgctcaaaatctcagttcaacacctgaaattaaaaatcctccctattggccaagaactgattttttaggatgttccatatattttgaagattatatgtaacaaaaagtggctataattttagtacaatgtaactttttacaatttgctattttatttggtgcatagaaattaaggtcatgcaatcactttggaaaatgaccaatctttttaaaagctggctctgtgcctaccctatggcaaagccattccactcccagctatgtccccaaaagaaaaaaatatttacctatgtccacatgtactacaggttcccaggtacacacaggcatatacagtgttcttggcagcacttttcataatagctccaatcaaaaaactatgcaaattcccccaaacagctaaatggagttatgttcattcaatataatacagctaagaaatgagaatgaacagccaacaactacacacaaccatgtggataaatcttgaaaaggtaatgttgaaggaagagagacagacacaagagaatatattctgtgtggttctatttacataaacttccaaaacaggcaaaacgaacctatcctattagaaatcaagatactgggtggctttgaaagaagagtaatgactataaagaagcatggggggtggggctcaggggtcctggtaattttttttctctacctaaatgtgggttgcatgggtgggatcagttggtgatgattcagctgggctattcagttaaatgtactcttctctaggtatattacactttactgacaagttttttaaaaagacagaaaaaaatgtcagtggagaaaatgttgttattttatcttttaaaatactgaataaaatgttaacaatttaaatgaaaatgcatgattggattttagattaaatatatcattttgataatattctaaaataattacaaatttgtgctcaaatgaaaagcagacctctcagtgttaataaacactgtgtgtaattcagttcctcaagtagtatgggttttatcactttcttccaaaacataaaaaagtgaaacttactaagtttcatatgctgttttaatgggcaggttctctggaaaggatgtaagtacatatggtggaaataattatagatgactcacggccatcagtggaaatttacacgtcctttggaacttcaatactgagcatctgagaaattgcaaatttctactatagaaaagacgatcagaaaaaataccgttttcttttttttgccattatcattttttaactatctccttttttgtgtgttaagcatggtatctcctttttcctatttcttttccttttcttctggttcttatcttttgttagatcaatttctgattttctatggcagatagagagctggttttatttttctagactattcagtgaaaaagaattcatattcctctttatttgtgaatattgtatgaatgaggtttgaacaggtatattttgaaaatttctttttaaattaaaacacattttatacttttccacattgagatcctaaatgcctgtgggctgactgcagtcttccttaaatactatttaggaagttatataacttttgttttctttgagctcttcccaaatattccaaatttcatgcaataaaatatacttatttgtactttaaattttaaaatgaacattatttttatcaggtcttggcttgcaaaattatggtcacaggactaaggtgagaaagtaaacgtttttcctactctctctgaattttccctcaagttttttttggcagttcatggttaattggattgttcacgtagagaactttccactcattcttcttattgaggccttagcagggaacactgtataacatagcctacaatgactgatttttgagcccttcccatcaaagctttccctatgacctgccctgcccaccacctaaccaatggttagtcagcaaagaataaattctttcccccaaaactccccagttatagtcttctgaaattcctagagtcccttctgtcctcaccttaagcacattcgaaagctcattgtttagttaagaccacaaacattttagctgataaggttgtgagcaaactctattttaaacatacctcttattaaatgtttgtgattgtcactatcatcatcaatattattatgataaattgatcactatgtgccagacacttacctgtgcattttgcatgcaatatatgcatattaatgttatctaaaaattaaagccttataacaactcaatgggttatattagcctctaaactgaggctcaggaaagttaagaaatggtccaagtcgtatccatgatgaatggctgagctgtagctcaaactcagagttgactgccctttctcatgccatattatctccctaaaattatcgatataccttcactaagggccttcaaatggggaccctcctatagaaatacaaggacgtttctggcatagcccctttctctatgaggtggttagtacagcatgggagtgaagcacccaaatggggaccctcctatagaaatacaaggacatttctggtatagtccctttctctatgaggtggttagtacagcatgggagtgaagcacccacccaaagatgaaacacttgtggaggaaagaagcctaataggattggataacctgacagatagttcgaatgtcctacaaaatcaaaaatggaatgaaataccaacttacacacaaaagaaacttgaaactactcaaatggaataggctgatgtgtttttttttaaattttatttattaatttatttatttaagacagagtcttactctgttgcccaggctggagtgcgacggcacgatctaggctcactgcaacctccgcctcccaggttcaagcgattctcctgcctcagcctcctgagtagctgggattacaggcgcatgccaccaagcccggctaatttttatatttttagtagagatggggtctcaccatgttggtcaggctggtcttgaactcctgaccttgtgatctgcctgcctcggcctcccaaagtgcagccactgcgcccggccaggctgaccattttgtatgggaaagtcagcactttcgtgaatgaacacattgatcaagccactgaggaaaatgtgattcaaatcataaggaggccaggacgaaggtcacacaaagagcccctgactctaatctacaatcatgacgaagggggccccagtccagttctaggagaagcctccctgccacatcctgtgacaagtttcacaccagcagggatcttgctgagccagttaggtgggctgagtccagccctggaagatgggccatcctcgtgtccttctgaagggcactggcctgaatgccaagacctaaataaaagcagattttgaaggtttaaacgtggaataaacccaagagtgacccagaggagccagctgaagtgctaatgcaccttcacaatcaaagatatgaaagcttgtcattaattgcgcacgacagtctgaaggaggagggtggagcatcttgctggctggagaaacttctggaaaccttaagtgctctccaacttcagcatccagggtaggtgaggcaacagcaagcctactgactgtttggggtgatgggcttttttttttcctggagagatgccaatcttcagaagccctgagagcctgcagagctccatggaaggtctctggcctaggtgcccaggtgtgggtctgcctgcactgggtctctgaatgagcagggctccctcgcagttctcgtcgtgggaaccctcagaggacacggcaagaacaacgttcccctcagtctctaatggacacggactgcccttcccaggcagaacgcacgcactcgcctgcagaaaccttgagttcaccattatttattatgtctgggggatgctgccatcccctgtgatgcccctgattaatgataatgtgcaaacctgaggtaattcgctgacatgttagatctttgtgaggcaccagaatggaagcggcatttttcaaactctgctctgcgggagccccaggggctgttccagctcaggggggaaggggagggcggcagctcccgcggctgctgctccatttttagctattttatgtgtttatttgtttacaatgcttgttaggattctggatggacaaagaaaagtattgcctacaataaaagaaagaaagaaaaaacaattaaatggaatattatatgctgcaaaggaacatgccaaggggtgcttggaccattttctggaattttccagtactgaatatgcctttgtatttttggttgtgtttttttttaatatttattatatatatttttgaagacggagtctcactctgtcacccaggctagagtgcagtggcgcaatctctgctcactacaacctccacctcctaggttcaagtgattctcctgcctcagcctcccaagtagctgggattacaggcgcctgccaccacacccagctaattgttgtatttttagtagagaactggtttcaccatgttggccaggctggtcttgaactcctgacctcaggtgatccgcccgcctcagcctcccaaagtgctaggaatacaggcatgagccactacacctggcccttgcctttgttttgatgatcgtctgcattcatctgctagggctgccacaaaaacatgccactgagcaggggtttgaacagcagtcatttgttttctcatagttttggaggctctaagtccaagacgaagctatcagcagggtggttccttccaacactgtagatggcacctcctctctgtgtcctaacgtggttgtcctccgtgtgtgtctgtgttctcacttccacctcttccaatgacaccagtcatactggattagggctcatcttgatgacctcactttaccttaatcacccctttgtaggccctatgtccaaataccttatcccgaggtactgggggttgggacttcaacatgaattttggagggacatcatgcagcccataacaaaatctgacaatagttgtatatgcacattctgtaacacatagaacctgtatgatctacctgataggtgaccgctgcccaatttcagagccctcagttttggtcatatttgcgctggtgttaacaccaggctattatctaaggggtcggcatccgcagtctatcatgttggaaagcatggcagccattaggttggccgttattgtcagatggcttctcagccccctcttgatttagttactgcctatgtcactggtggattcccaataagctttgtaattaattccagtacttgcctttgtctattcaaattgtacatgcagtataaccttaaccacctctaggtccaaaatgaatgtgccactcttggtgccactctttgtgcctgcagcacattctgcttttctaattcattctgctctcctttagtttttaaaaagttaagagccgttacctagccgtagctggcaattcttgcttgcaggtaaactgagttgccatggctgctttttaggaaggtctctgcctggttggtgaacagcccctttattcccccagaacaacatggatacttctcctcaaataaatccgtgccccgtatggaccgtccgctttgccagggaaatgggtttgtagcccactgagagggctgacccatatgaccttagcaacaaaaatatgaagtgcacagctgtgtttgcaccatcagcatggccaaacaccctttctcttctcgtttctctccacacagtgatgtgcattaactggcacctggtttctgcatcacacatgcatattgggagaattgttattctagaaggggatggaatgtgacacacctcagataattgctctgagaaatgagtatgaggtctttttaaaaaaactttacatttaaacacacaaaccatttaaaaaaaccactcctccaaaacagacacacaagtgaaacaaaccaaatcgactgtccatccatttaattttgaactatctgcaatatcaccttaaagctctaagctcctaatgattttggtcattacaaatccaaaataacattatttcaaaatgaagttttactatgatttttcccatttgggaaacagtatatccaatacaacaagatgcatgtgtacctccattaaaattttaacaattaggaaaattagaatttatatatgatagattaaaatatgattatttcctaaaagttttctttagttttacgggtttgcttctggattgctttcaatagttattagtgaatttaaaatttgattcagtatgaaggtaatgtacacccatcttcttcagaacacgtattttaaaatgtgacatcatctgttctgagtctaagcactgaagaatgaagtgtccacattcaccgtatttatgcacagacacattctcattccattgacatttaagtgatgtaatgaactaaaactgccacaaagagaggagggttgggaggctgagctctggacagctctgtcactgggcaagtaacatggtgtttagaaaatctctgctcctttctgtgccattggtctatatctctgttttggacaaaaaaccaaacaccgcatgttctcactcataggtgggaattgaacaatgagaacacttgcacacaggaaggggaacatcacacaccggggcctgttgtgggatggggagaacggggaggaatagcattaggagatatacctaatgtaaatgacgagttaacgggtgcagcacaccaacatggcacatgtatacatatgtaacaaacctgcacattgtgcacatgtaccctagaacttaaagtataataaaataaaaataaaaattaagtaaagtaaaataaaatctctgctcctgtttgctgtccccactgataaaatggtagagcagatcactcctaagtcagagcttgtgtaatagctgcgtaggagtgtgaaaccaggctacttgggagccagtgctggctccagaactttccagctgcgtgtccttgggcaggtggtttacactctgttgcctcagtttctccagcaataaaataagaaaaaaatcatagccagctgatcaggttgttgtggaggattacattattaaatcttggccaagccctcggagcagactgtaaccctagtactgtctcatgcataatcagttactgatgttgttttaaaagcactgggttaaaattgctgcacctaagatctagaacctgccctaccactgcctagctgtggtggctggaggcatagagccccatagttgtggaaggaaggagtggccccaaaggcctctacctagtgaagttcacttccccctgcttccttccctaatgtggtttcttagagttgacataagcatatttctctgacacacaaacagatgactttttctgcaggattggtcagaactttagaagtaaagtgctcgagttgatgagataatttgcagctaactgcttgaagttcatgttggttatgctaaaccttagagaaagaaagctaccgtttctgaatctttaccacttatgtttttatccgctctgacacattaaagggagaaaaataccagtaaagaaatggctagagaaaatggaatatgacagctagggtctagggaggaaaaccgtgaaaatgtctgtaatgaaaagaaaattgctagacaaaaataatttgtaatttgtcttctacatgtggcattctaagactactgaatcaatattgcaagttctttgttagccataataatagtaatttttaataaatgcccaggtgaggtggctcacacttgtaatcccatcactttgggagatccaggcaggaggatccctttagtccaggagttcaagaccagcctaggcaccatggggaaaccctctctctacaaaaaatacaaagattagccatacatggtggtgcaaacctgtagttccagcttcttgggaggccgaggtgggaggatctcttgagctggggaggtcaaggctgcagtgagccaacaatcatgccactttgcacttcagcctgggtgacagagaagactttgtctcaaaaacctaataaacaaaacacttcaggtgcatgactaagagtaagcttcgtgttgggctcaaaatgctgttcagttgaaggcgctggagaagagagggcagaaagctcttggactcttggacagcctcgcagaagcaaaccttgctccaatgagggaggcaccaaatggcacaggtggctttggcaggacgttattgtaagcctgccacgtttccgtggcatacagtttaggatccaaggttctttaatattgtgtttccatagctttttcctgcaaggcagacacgtaacattaatgagctcacagcactcttggttttagtcgtagttactgaatcctcattggctgaaaagctttgtgtattaagttacacaatttttttcttttgcatccaaacttgaaataaaacataccaatttgattattttatattaattataacatgacttacgtcattgtggtttattgaggttaaaaattgatgtgctatactcagaagacagaaatgattattaagataaaagaggcccctgtaattctatgccccagagattaacattttaaacatgttggaatagatttctcctttcattttgcagtgaaaatatatgggattacattattctaaaaccgttttttccactgaacctattacagcacttttccatggactacatatgcctcattgttaaattttttagtcaaacactacatgcaaataattttaatgtcatatggttataaagaaattataacaacaaaaaactgagaatgcattccccgttttcctcccacgaagaaatcactctcattattttttaactaaatttctggtatttaatttttttcaatcttattcatgtatttattgacttcatattgtgatggttcagaaatttaggtcactttgcccatattcccatcctcccagtatgtcttacattttagttaaatctattataatcatgtaaatattaagtgtcaagccaagttgtgtgctatgattacatttttcctttttgctttaaacatctaacatttccacacttcaaagcacaaaatgattttccacatgttcaactttgtcagggaatttattctattttgtttttccagcagagacagctccaggagcccctctaccagcctccaatctgaaggggctgccaccttaagtattcttctcatgtctcccctatgctggatttcctatttcctaaatcctgtgctttcccatgtctttttttctccctcctttcagcgggacataccatccatcatttctgagaaaggatgcatgagaagaacatttttaagaacttatgtttgcaaaaagaatataagtttggaagtaatttttatcttagaaattttaaaaattgcaaagggaatgatttctccattgtcttttagctgccagggtaggggttgttatagttctgattgctgaccttcgggtgtaagttcactttcttccttttgggtgggcagtgttgaggccattctctttattcctgaagtcccgtaactttatgaaggtgtgtgtggctgtagtgtgctgggcactgagtggcatcttggaatgcaaacactcctgcccctcaatgtagggtgatttccctgtatttctttatggatgataccattcctactctttccacctttctctcccgctggaatttctactgttcaaacagacctcctggatggaggtaatttttttttaaatctttattattttgttgtacaaatctcctcctttttgacagttcagaaattttcgacttttggttcttttctttatactaactttcagaaaatatctacacttccatcttaaatacccaataatctgtttcagtttagccagagaataaaccccttaggctatcgagatgcttctggaagcagcataatgtgcagctgaatgtgcaggcggggcacgaggacgcagaatttcaggaaacccctccttgttcagcccttgccccactccaaaccccaaaacctttgaggcctccccctccccaatcctgtgtgcaatatttgctgtttttccatttactccctgacttcagattgttgagcttgagttcatggacatttcatagtaaccctgaaatattataagtctctgaaatagtgtatttctcttcctttctcttctcgctccttctcttcctcctctctctgtctctgctatgaaattaactagtttcttattacaaaccaaaaagtatctcagacaggtctcaatcgattgaggaggtgcacccaggacacaggtctgtgccttcctccaaagatgattttgagggtttggggatttaaaggagaaagggcagatattggggaaagagaaagagaattttaaatttcagtgaatctttatttttacataagataaaataaacatagggcagaggaagcaaatcagatgtgcatttgtctcagatgggcagaggaatgactgagttctgtccttcgtcccgcacctgtgaagataagctatcaatttatctcgtcagggtgaaatgcaacagaactattttagggtaaagatcttggggcccgcaaggaatttcctagtgggcaaattgtgagggagctatgtagtttttttttttttttttttttggttaatctttgtagctatcttattttggaataaaatgggaggcaagcttgcctgatatagttcccagcttgacttttcccttgggcttagtgattttggggtcccacgatttattttcccctcacataattgatgacattttagtccttattcctttacttttactatttttaaaattgcttataaaatcccaatatttgtgtattttttaatcaattcttagataagttactgcttactataaattcgtgtacattttacaatattccatattttaacaaattaccctcaaagacatatcaaattattaagtttcatttctggaaagtatgtataaaagtgttgattcttctcttacacttcctgacattaagcgttattttttaatcaattttatatacaagtcaattttatgccatcattcatacttctaaatacgtacttttagaaagctacatattcctgaaaacagaacacttattctttccacacaaaatagtcatttgaaaacttctgcagatatagacaagtaagtcataaaacatttaaatgtgtttacagagatcaagactaattattttgtagattaaatctttgtgtgcgtgtgtgtgtttaagaagattgtggggattaaatcattgtgtatatgcacagtgtttaagaagttaatgtgctggaattaagaggcaaaggcaaataaaattgtttctaaaaatttgtgacctatctttgtgtcagaaacagcttatatttaaatttgttgtttctataagtccacttaattgtcttgattgtttaaatacaggtagagtaataatgatcaaaatctgggagccctctggtggccaaaatatctttagctacagacatacatctttggcttatgttctaggttctcaagatctagttattttaaacttcttgaaagtataggcatttaaaaataatcaacagatgaacaaagtgaaataaacaagaaaaaaatgtaattgcattaggaaaacaatgtaaatttgaaaagtgatagccaggttcaactcagttcttgtaagtgtttttggaaactggcaaaaatcaaatgcatgtatttgtccgggagaagccacagtatcattggaaccttgtccactctcagcaatgcaaaagccctttgaggtggtcccatagaaatttataacatgttaccctcaatgaagtgaaggcatttaaattggaggaaaaaagaaaagaggtgtgttagctgtcttcagaggtcagaagggattctttgtcataggatcacattccttacctggacagtgcagggagaaacggaagctgaaaaaacaaaacaaaacaaacaaacagtttcaagtccatttaagaaataaattattattaaaaactatttttaaaaatggactgccttgataagcagtgagttgcccatcactgtgagtactcaagcagggagatggaaacacacttgttagaattgccatggaggggactcaggctctcaagcttgggtctaaagtacatggtctcttccagtgctgtaaccctggggctacgtggatcaacaatcaaccatcaggtaggaactgttgatggcctcagagcctgtctctttaaatcagagtttcaggaatgaaaagtgatattggcatgagaggtcttgggtctagacaggagtgaatgtcatttgtctcaagttctaggaggggtagatgtatccagctgcatgccgccttacttctgaagggataaaagcagagatggcttctgatctccagcaactccttagttgttcataagcaatgaatttagaatcacagatgggaccacacatatgtctgtgggatgctggcgtttctttctgaacaacagttccatttttattgcactccttgtgaccacatctgcatgtttcacagtctttttgagatttttgcaggcatgattccgtcacccaaaacagcaaggatatgctactcttatttctatgccttcaaaaacaaacagatctgcagatttgacaaccttgctgaaaatattttttttttttttaccaaacgtgtttataatcaaacaagttgtcagaacaaggggtcattgttgctttctcaagtatttcaagagtaagctgtaatggcatttggagagagaatataattttattctctagaacaggggtgtccagtcttttggcttccctggggaacattggaagaagaattgtcttgggccactcataaaataccctaatgatagctgatgaactaaaataaattgcaaaaatgtctcatgttttaagaaagtttacacattagtgttgggccacattcaaagccgtcctgggccgcgggtggcctgcacgccacgggtgggacatgcgtgctctaaaggaaatgagatgaatggctcgtctcattatttttaatggaacagagcttctgtagttgatctggatccatttgaacaggtgatttaacccacttgggtgcctcagtttactcatcattgaaggtaccttttcacatgcagttctatatcaaatgttcaaacagagcttttgggagacgtttaagctcagacctgaaagaagagaaagagccgctcatgataactggaataacagcattgtggggagagagaaaagcaggtgcaaaggaggccaagaagcatttcatgtgtttcgtgcagcaaaaggacaacacatcccaagccaagtagtagaaggatagattgatgagaaaggatgttgaagagacacactgatgccagatcttgcaagatcttatatgtacatgaagggaattgggatcttattttagtgcaaagacgagccacttttaagcattttaaacagacgaaaacaattttatttacatggttcaaagatggttctgggccagatgcggtggctcacacctgtaatcccagcacttcgggaggccaaggcaggcggatcatgagataaagagatcgataccatcctagccaacgtggtgaaacctcatctctactaaaaatacaaaaattagctgggcatggtgatgtgtgcctgtagtcccagctactcgggaggctgaggacagagaattgcatggatctgggaggcagaggttgcagtgagctgagattgcaccaccgtgctccagcctggcaacagagcgagactctgcttcaaaaaaaaaaaaaaaagatggttctggggagaatgaattagtgacggaacaggaacagatgcagagaatccaggtgcacttgggactgaacagggtggctctttcaaagatggaggaaagtgggtagaagtcggatatattttaaaagtgggctggacaggagtaccctgatgttgcaagtgaggaaaactgaagagtcgcaatgactcctgttttgtttttgcttggacagtgcttgtagatagaatgaaaagcaatgcctttgtgtgtatgggggttctaaagtgagggagtcatgaactgaggctcagctttgggaaccttacatttaagtgactgtgaacagtttctaccttcctctgagcctgttctctatttttccccattgtactcatcactttctaacatgctacctagtttatttatcttgtttattgtttcttgtcaatctccctgctccacctgctccctgctcctgcattgaaaggaaggtccatgtgggcagcgatttactgatttacttttattgatgttcccagaacagtcccggagcctccaaggcattcagagaacctctgtagaggtgtgaaggaagcagtcaggctgcagagttcaaaagagagacttgggagatagaaatgtgggagaaattcatatgtggatggtaaaatcatgaaaatggatatggttacctcaggaaagagtgtgcagatggttcaggaaacagctggagaatctctagttgatgtttggaggggaaggatgagatggcaaagcagaaccagcagtgggcattttatcaggtgagaggttagagggggattgtcctagaagccaagaaaagagaggaatttcagaaaaggaggtgctcaccttcagaggtgctttctagtgaagtatgaggtaaggccaacagttgcgggatgggtgtctagggatgagaagacaaatgatggagctcagggaacaagaaggatgccaaagaggctggaagcagatgttaatgatggtgcagccttctggaaccagcctctaaggagcaggggtctggacctgcacatggatgggtggtgccaatctgtgatttgaaagccagcatggggaccaaggatggaccttctctttatctggtcctgatgaaggtcaggaagagcagcagcctatgttgcaaaggatggggtgagattgggtctacagaggatgcccaagtttcagttaagacctggggaaagtggggatgatcagagcctatgctgctgatattggaggggaatttcagagaacacactggaagaactgatggaagaaggggtgattggacaaatgagcagacattcagtgcaataccgggtggtctcggtatgagcagtgaggcttgcatttctgatgctgattgagatggacagaagaatatcagggcactgggcatagttgttattggatgttcagctatgtccagctcaccacatgtgatttaaactaggcatttggggtttatttttaaagtgcattttagaaattcccagataactccttgcttgcaagccattatctagtaggtgtgcaataataatgagcttctcaatgccatcattttagtatcctaaggaagtatattacaatgctcgttattaggctgaataatatgaaattgctgttttatatgtcaaatgtggaccaatcaagcaatttcagatggttcaacctagcactccttatagcagaaagtatgtcaaagaggaaatagtagcaacaattgcagtgatacaataaatcaactcttgaaaatactttgaactatatggaataaaaataagattaacatttctattttgcaaagttgaatatcagttgacttttcagaaatgactgggggttgggaaatgactcttctcctggcccccacatttaccatgtggcacctaactctgatcaggtgctacaagtgggaattctgctctagctttcaccttagggttgcattagaatcatctagggattaagattcctgacactcaggctgtaaaccaatcaattagatcacctagggatggaacccaggtatctatacattttaattggccctgagtggtttcaatgtatcaagattgagaactattgctctaaaccagtgctttcaaactgtcatgcatatggttcacttggggatctttattgccacctcccctgcctaagcattctaattccatgggtcttgggtgcaacaaagatgtgaaaattttttaaagatctccacgtgattccaatgtgcagtaacattttggatgccttgctcagtctaaaccaagagctacattaagccagcggttctcaggcatgcatcacatcaggcttacttggaggacttgtcaaaccagagtgttagccatggctctaagatttttattccagctgccagaagatgggtccaagaatttgatttgctaacccattctcaggtgacacttctgctactggtcttggtgccacatcatgagagcctctgtaccaggctctaatagaagtactcttgggttcctgtttgtgggtggtatggctgggatctcctatattccctgcatgaaattttcttatctgaacttgcaggaaggagttccaagaggaaagacgtgggttaaaaatcccatctgctccctactgcctccttatcttcctgtggtcatttttctattcttttctgccatattcatttcctgctgctgctgctttaacaaattagcacacacctaagtggcttaagacaaagttattgtcatactattgtggatgtcagaagtccagagcgttaaatgctctcagtggtctaaaattaaggtgttggcagagctaggtccctttctgggggctctagagcagttctgcttgagtttcccagctttttgagacaacttgcagctcttgactcacaatccattagtcccttctctctgcaaagccagcaatggccattcaagtctttttcacattgcatcgccggctctgatgcttgcttccacttttaagaactcatgattaccttggacccacgtggataatccaggctaatctccctacattaaagtcagctgaggagcaaccttaactcccctttgccatgaaaccttacacattcacaggttctgcggattgggatgcaaacgtatttgtggggggattgggacattattctacctgtcacacctgcctccccccagaccccagagctggaatgcttgagtgtgaaaccagctctgcctcttagagctgggttacctggagcaggtcatttaacttctctaaactgctggaacccagggaaataaagtatctacctcacagtatttgtggcagggctacctactgtgggtaatgaatcatatgtatgtgtgccaggtcctggaaaagggattttagaaaatgttattattattgttataatgttcatcttttgcaattgtattaagagtttctgcctatagtcacacagttcctcatttcataggcaaacaccagtttctcgggtatcctttcagagctactctatgcatgtataagcatatgcaaatatataatttatttgcagaagtggtaaagtattatgcctatgtgaataatacttcattcatgttttttctttcttttaaacagctgcattgttcctattttatgaatatacttcatttacttagctagcctttattgatgaatattttgtgttcaattcttttgcaactatgaacagggctgtaactgatagtcgtataaatcaataagcttgcatatgcaccgtatatctgttgtataaattcctagaagtgagtcttctgaatcaaaggttatatacactttaaacgtgtgatagatgttgccaaatttgtctctgtatatattttatccattttcatttccatcagtactatgagaatgtgtatttccatatctctttggctgattcatgtcacccagcattattatttctgccgttctgacagttgagaataacatttcatgttttttatttgcatctctcttttgaagaaaaccagcatcttttcacacatttcttagcaatcatatttccttttcaattaactacccatttatgtccctcatccatcatgtttttgggtggttgatttttttctttaatggataattaataggatttactcacagtttaaggaaagatctattttctgtggtctaaattacaaaacattttcctactttgtttactttttgcttttgctgtaaataattattttttatgtggttaagtttctaagttgtttatggaatcataattttgtatcatactcagatctttgctatcttaggctacagaaaacaaaatttcccatatttttgtctaataataacattattttatgtttgtcatttgtatctctggaacttgtttttattttttatttttatttttttcttccaactttttaaaacatttaatgatattctattttaagttctggggtacctgtgcaggatgtgcaggtttgttacataggtaaatatgtgccatggtggtttgctgcacctatcaacccattacctaggtattaagcccagcatgcattagctatttatcctgatgctctcctttccccaatgccaccaacagtccccagtgtgtgttgttcccctccttgtgtccatgtgttctcattgttcagctcccacttataagtgagaaaatgcggtgtttggttttctgctcctgtgttagtttgctgaggataatggcttccagttccatctgtgtcccagcaaaggacatgatctcgtggaacttgtttttatttgatgaattcgataggaatgcaattttagttttttccacaagttccagttgcctcaacaccatttatccatacttgattctgtttttcctaccgattgctaccttatttattctttttttttgggtggggggcaggttttctttaaaatctggttgtttttgcatgtttactttaaaactggattactttgctggagaaaaaaatatctttcatattttgctagagttgtttgaaatatatagattaattcatgcattgctttctttaggatattgtgttcccatcttaagtagagtctgcattccgcttactcaatggtcattttgtgtagtaaagaagcatttcaacgtgctgttcatatggtttgtacacattttttatacttatgctttttgtttctattgtgcatggatcttggatctgaaagcatgcttctttgtacatacttaggcaacctatttactttttactttttactcagtcacttcactgaattatctttaccatgtctaagagtttttccattggttctcatgaactttttatttatacagttatattttgtgcaaacaatggtaatttcctttcttttttaatatgcacagttttaatttccttctcttatcgaatggtatgttctagcatttaatttcatcactatctgattcattccctgttctcatttctaattttgttttgttcttcttttcttgcttagtttaatcaacaatctaatttttatttcaaaacttttgatttatttaatagctctaacatcattctgttttcgaatgcattgattcttgtgtttatgattttattaacttgttccttttgcttttttgttcgtattttattgattttttttctagttcttttagttggatgcttatgtcatttattttcatcctttcttgttatttatatacgtatgtgtacaagacttaaaatgtctcctgagcattgcttttaacattttacctaggttctactctcatatataacttttgtatatgttctccagtcaccgttttggtttcctttgtgattcaagagtgaattcttggtcataaatcctgataagttctaactttgtggggaaatatttaatgaacttctctttgtgacctaacatgtcttcaagattggcaattttttccttgattgccgggaaggaatatgaattatctgtccttaggttacagaattaggtaaagtacaaatagatctaactatgttgtttaaatcttcattatttttgcttttgatgtttaatcaacaatctaattttttatcttaaaactttacatttacttaataggtctaacatgattctgttttcaaatgcattcattcttgtatttacgtttttattaacttgttccttttgctttcctcatgcatattttattggcttttttctagttctttcagttggatgcttatgtcatttattttcatcctttcttattatttacatatgtatgtgtacgagacttaaaatgtctcctgagcattgcttttaacatattacctaggttctacttcatatacaacttttgtaaatgttcttcgatctctggttttgtttcctttgtaattcaagagtgaattcttggtcataaatcctgataagttataactttgtggggaaatatttaatgaacttctctttgtgacctagcatgtcttcaagattggcatttttttcctcagttgctgggaaggaaggtcaattatctgtccttaggttatagaattaggtaaagtacaaatagatataactatgttgtttaaatcttcattatttttctttcgttgtatactgggtcagtcatggactgagagatgtgaattgaagtccctcactattgacatacttctgcctatttaaaaaattcttgtaggtttcactttattaaatttgatgtaatattttcatcgtgtgcacatattcatacctcttacatgtttattgctgagtatatgcttactcatcataaagggccatgctttgtcacaggaatgctttctaccctgttttaactgtgtctgctactcagaacatggccatggctttcctttccaatttgcctgatttgcctttccacattattaatatttgatatttgtaaatactttaaaacttaccacaacaatgtatagttaagtttgtggtccaaagggaggcatatgtagcacattcacattgtaaatatcatattttacgttattctttctctttatatctttattttgcattttcccctctttttctgtgtaagtgtgtgcaatatttcttttcataatatgaaaatgtgggatgtttttagtttttataatggctaactctgtaattacaaattgatataatacaggtttttttgtttgtttgtttgtttgtttgttttattttattattttttttgagacagggtctttctctgtcccccaggctggggtgccgtggtgcaactgtggctcactacagcctcaaactcccgggctcaagcaatcctcccgcttcagcctcctgagtagctgggaccacaggcatgtgccaccacacctgactaactttgtatattttggtagagatggagtttcaccatactgcccaggctggtctcgaactcctaggctcaagcaatcctcccgccttggctttccgaagtgctgaggttacaggtgtgagctaccatgcgcagccagccttcttctttttccaaatacagtgtcaacttcccactatggccagagatgaaattataaagtattctaagtatgccactccccaaattaacttggttatatttttattggtttttccagtatttatatcttgattaattgatttatcaccattaaagaatctatttgattcctgtataggcatccctctatcccttatctctcatcttctttgtcctatggacttttgttacagtaattctaaattgccatgatttacaattgatttctgtacagtaatttccacagatattttactcctaatactatagttaaatagaataaatgtggagagacaatactttgctatggttttgtgatttttcatcattttattatgaaaagtcataaatatatagaaatatgaaaataattgtattgtgagcacccattaaccattacctggattgtacaatcaatatatgcaatatttgctttacctattagctatccatttagtgacactcatcattccattgtattcacaataatttttgtattgtgtattcacaataatttttgtattattgtgaagtgtattgcacttcacaataattttcagatagcaatcgactttacctttgaacacgttagcatacatatcgttagctagagttcaatattagtggtctttcctcattttctcattagctaattttttttctgattgtcaggaagattttacagcccctgcaattcctgcctattttcccatttgaaaatgtgacctgtaatcatataattaaatgttattctgcctgggtataacattttgttttcttgagaatttcatagatgttatcccaatagtttcataagtagactgttactgtgagaaaatctgagattggtgtaattttaatttacttttttttaagtgaactctaaaaaattttttttctaattataatttatctacaaaagtccaattaatgaaatactaatttagatacagttcttgctaaatttttaatatcaactattcttagggcattgtgatcattttcatctgcatattcaagccttcttgcaatgatacttctctattatttaaaaaaattatatttaatacttttttctttttcttttcttttattattattatactttaagttttagggtacatgtgcacaatgtgcaggtttgttacatatgtatacatgtgccatgttggtgtgctgcacccattaactcgtcatttagcattaggtatattaatactttttagctcatttatgtgctgctcttccccgagcacaccagttatgcagattttgaatctccttgtcttcttccctgtctctctcccttgaatattttttcctatctatctatttatcatctatctatcatctatcaatccatcaatctatttatctatcatccatgtcgtttttttgttttgttttgtttgttttttgagagagagcctcactttgttgcccaagctggaatgcagtggggtgatttcagctcactgcaacctccacctcctggattcaaccgatactcctgcctcagcctccccagtagctgggatcacaggtgcatgccaccatgcccagctaatgtttgtatatttacagtagagacggggtttcgctatgttggccaggctggtcttgaactcctgacctcaagtgattcaccagcctcatcctcccaaagtgctgggattacaggtgtgagccaccgtgcctggcttggtttatgtttctaatgcaattcttcctcttctggacagtgtctagtttctttgggttgattacaatatggcaatcagtttttttattttttaattccctttttttctttcaagtattctgatagcttatattccatctttctctcgtctgaacttcatcttttacctctgctctgagctatttgattgcttcattcagttcttttcattcatgaccatacatttcgttcaaatgattcgtcggctcaataactactttttctggtggagcattatgttccacttgtttttccagtgcttctctgaacctggtcttacattacattgatatcaatcccatgctgggagcttcttgatctatgtctcgctttttggtggaagtcttcctagatcaggtacttgcaaaaggtttatttggagcggggaaagcataactagattagtaggagtcatcccccatttacagggaagtaccttctgatatcaggttacatttctgtgtgagttgttccacttcacttctctccagcctaccaaggtcagcaggttgtgcgcagtttgtgattctgaggacctctgcctcacccattcttgtggacgtcgagatagaatttatctggccctgcctctcctactattttatggtgccacacactcgaaaggagaggtacccatcaccaaagtcatcaccaaagtctgtgattaagccattggtagtgtttcctctctgtatatttaccctactttgagaagaatgcttctgcctgagatactgcagagaccttcttgtggcgacttctacattttcatttgatttcccttgatttgggaaggtgatttgcatgtacggaaatcacttagtttttttcaaagatgaattgtataaactctgcagctattaaacacttccccgtgtgaactctttgcccatccttcctcttcattctagaaggattcctttctgttctatatagtgcctttacattgttatattgctttttctgctttagtcatacattttttaaagtgggaaaattgggtaattgaaaattgagtgtttcagagtggtcttcacagaaaactttcacagatatggtttcatttcatccttttgacaatccttcaatttgggcattgtaatcttcatttcacagaagaacaaaagaaactcagagcacatgttatggctaaagccacatacgaacacgtgactaggctgagtttctgacaccttcattgtttcattatactgcctttcataactgggaatgaaacctgaacagtcccctgaacatggtgagagtttagacatttgatatagattagaaaaaagagaaaattgccctgattcatcatgagcagactttgccatggtgacagactgtctaattggcttatatatatctttctgtttcagtccgtaagtttgctcattaggatgtgtttttctttatcctacctaggcaggtatttggggtgtactcgtgaaccttgttcccatgttagggccctgttggagagtagaatagtttcatgtgccaggcataggcccagccaaggacatatcccctgcttcgatgtacttacacacaatggatgcctttgctgattcaagggccaaggctcttacttccttttagtcttgttagtgactaattagttcatctcctgagcttttcagttagaatacttttacaggagggcagggactgtttgtactttatataacctcagtgcttcaagcatttcaatataaatgtttcttaattgaatattatctgttcttaaaagaagagttgtagcactttgatgttctacttttgtttatctcttgtcaacagcagcaaatatttattggcattagtactaagcaatgctcagatggatggtggaattgtcatcctaaggtgttggatcaggacatgggcagtggtccccaaggatagctggaaaatcgttgagggtaattgaagctttctgggatgttttgcaaatgcaaaggaaaacatgcattttgttgttgcaggcgttttgtgcattgaggacataaagtcatttgcctgtcatagtgcagaatctgtcaggattgcagctgtcagcttgtcagtgtgacctttcctagtgtgacataccatggaattttatgtcatgctaggacaatatgacaggactgtgcattgctttttcagtagatctctccatccttatcttctcaagaaagaatacattctgaaagagataagggagtacgcttatcacatattaatcctataaagtcagaaagcagataaaaaggttatacattaagcttgattttatgcagtaattcacataagtgtgtgatattacttatgtgtgtttgcatgtatgtgtagatatacacatatatctcacacacacacacacacacacacacacacacacacacacacacacacacacaaagtctttaaaattcaggaaccagagaggcagccatgtttctgtctagcagcaggcaaagaaagactggaaatatccaaactcattttaaatgccattctgaacttaatatggaattacctaattatgtctaattcaacaactgaagcataaactactgatttcagcccaagccagaattttacagatttccctattttcctgtatagaatataacacttggcacaaatcctagatcacatcttctttgcagctattaccaaggctctatgagccttggtagagaatggtttgcatcatgcactaaaaaaaaagcaactaaatcctaacattttgagtttctttttttctattggtagggaactctcacagacgttgatatcacataacctagtagcatcctgcttgctagagcatgagtgctgtattgtatgctttatgaaatagaatatagaagtttgcttgatactatttggcaggtaatatattttatactttgtataatgctaataagttattagagtaactgttgaaactaaactttcaattgaaaaatgtttacgagcaaaacaagaattgcatacgatatcactctttaacttcttaacttcactaaatatcataaacctctttatgtcccgatgcacacgtttcctgaaccagcttgtaaaaggtgtaattgttcagaaatcagatttgaatactcagttttttatttcacaagttagattgatgcatttacagagtattttccaggatacctccaggatacctgtgtgtgtgtgtgtgtgtgtgtgtgtgtgtaatatagtgtatacatagtatgtatatactattatagatattatatagtgctctgtatctatatatagtacatatagtctgtgtatctatacagtgttctgtatttttcattggatgtatttttctccacatttaatcatcttgattttgtgtataatgggtaggaaaaattatttttgaaattctcctggttgaggggcctatcggtacttcatagtcccagggaggtaatcaattggaatctttcagcagtagcgctgactgttgagggacccttctgtcataaccagtatccacagtgaactgggaatacctccttaaacccatttatgctggaggttgcaatttttttgaatttttgcgtcagtgaaaaatcagactttgatgatgaccttgagcagtaggatataaataactcccacatgtttagtgttccaataatggaacacttgggtattgcattgatgttaataatccaaatagtttctggcgtgcacacatcctccagccaccctgaaattcgaaccctagtgatttgatttatttgtacacttctaggcagtccaccatgtgttctggaaacagttgcggctaaattactatcattgttgtgctttggcacatggatgtttgatgcaactgagaaagcaattttaatggaatttattctgacagctatatatacctggtgcagacttaatatgacatgatacgagccccacacacctaattgtgtaggattcttatgaatacatcacatggatacaaaaccaagaaacactcaattatctcatgtgtttgatgtggaaatttctttactaccccaagtctgttacctttcataaccattaaagcagccccactaatctttttataaagatttatgtttcattcaaaaagaagggatgtctaagccagtagaaagtgccatggggagctgggccataatagtaagtgctctcctttcattaaaatacctcctgttcttttttataaatgctggagactggccttctcttacattgtggccctttggagtctgaacaacttaacctcagccatcaacaggcgatccaaattccagtggggcagagcctctggatgatggggctgaatgcccagagatgacttgcaaagcatctcggaaatctttggccttcctgcccccaactccactgacgtgcatgcttatttgtaggcctgcccttgaaggacaaggcatacagattttcatccatcctggaatggtccagccaactggccagaatgcccaccaacagaacatatcttgagcaggagggtaggtgacctgcagagattcacacgtttataaaataagattgaaatcctaagatgcaaaaaagaaacaaatagtactgttcaatcgttactggaaattttacatatgcgttccttagtaagaagcttcctatacatttcttttcagagatatagtaatgtctgtcattaaaaagcagcaacaacaacaaaacttacctttgataaagtctcagtatattcaataacaatcatatgtaacatagaccctgtgagccctgatggcttagataaacttcatgcctatgaaagataaaaatctcaaacatttgcaagcaaattttatttctgaattaaaacctatgttgtaggctgtgaatatgggcaattcatcaaatgttctgaagtcattgtccatgaatcctaaatcaagggctttatccctgtaaatatttttttccaaggccatcaagcttgtgtttctgggtaaataacattttttttcattactgaaagcaaagtgctgagtttcatgtagttgtgaatgaattaataagattgtggccagaatttgaaggcaaacagtggtacatcaaaaacatgtgggatctattttcaagtgtcagccaggactagaacattttaaaaatctgtacttgacggcctcttcagcaaactaaaagtgatttgttctgctggttttcccagtatcaaagcaagcaggaatcttcagatgtattattttatgttacgttgtttggtttggtttataaaggtgctattgtgccatggtgtgaagaaaatttttttttaaatgagtaccagagtaacttgttaaccatttcctgtatagctttctaagacttttcactgcatattgacatttatgttgatgtgtatggagaaatgtcactgaacatttcattgagtttttctcctgtgtatcccaaggcagaactttcttaaaagaaacacaaaaaatcaaatgtaacatattaaattttatttctgcctttgaagaaatattttaattggcttatgtattgtggatttggccatcaactattataatgtatagaattaattaaaaataggcttaaatcaaatatattaatgtaattgtgaaaattcctatgaggtacagtatgcctaatctttattaagaaatttaagactgtttcatcaaagaaactgaagaagtttagaagtaaaaaagatatatagatgttagctcttctgattaccttggctcaatgttttcatgcttttatcttcaacaaaaactgccaccagaagaacacaggcataagtcatatgatgcagcagaactagcttttaaaataactgcttgattactgtttagaatatagcattagacaatacatcatagatgactcctgaaatcacttttttggtcacacatcaacatctgtgggaggtacaagtttattttgatttctaaaaagtgaatgtaataactggatgttttcttttcatctttcatttctgagaatacaaggatacggattagtgtcatgcatttacaatttcacattgtgggatgtacagctcttacaggtgaggaatatacttgagaaatagtcatgtatataaaaatattgtgatagaatgatgctcccccaccaaagatgcctaacatcctaattcccaaaacttgtgttatgttacattccatgggaaaagggaagtaagggtgcagctgcagttaaatgaccttgaggtagagagtttatcctctattatccaggtgggcccaaactaatcatatgcatccttaaaggcagaagacctttttcagacatagtcagagggaggcgtgactacagaagatggccggagagagtctatggtgctgaacttgaagatggggaaaagggccacaagccaagaaatttcggcagcctctgaaagctggaaaaggaataataataataattttctcttcagaggcttctgtataaatgcagtcctgcccaccttcatttagttcagtgagactcaagttcaactcctaaccaccaaaagtataagatataaataaatgtgtgttgttttaaaccactaagtttgtggcagtttgttatagcagcaacaagaaaacaaaataaatatgaacaagatttagccttttcaccctccatccagagacaaaactctcataattatatttttgaattgattttgtgagaatatactcctaaaaacaaaagaaatagattttgtttgcagcatacattaaagtactccagagaaatcagagagccagtagaagattagataaagtagatagataaatagattgatttattatgataaatattattgatttattattgatttattatagataaatagattgattattatttattaggaaggtcaagcagtcccatgatcatttccctacaagctgaaccaggaaagctggtggtgcgagtcagcctgagtctcaagatttgagaaccaggggacccagtggtataattcccagtccaagttccagtgcttgagaactggggggccactagtgtaagtcctagagtccaaatgtcagagaaccaggagctgcgatgtccattgcaggaggagacagatgttctagctcaagaagagagaatgaactcacccttcctctatgtttttgttctatttgggccttcattggattggatggtgtgtgcctacgttgctgagggccatcttgtttactcagcctactgatttaaatgctgatttcttccaaaaacatcctcgcttcacagacacatccagaattaatgtttcaccagctatctgggcatcccttagccagtcaagttgacacacacaaaatcatcacacacaataaacagactataaaacacagttgatttccatgttgacctattgagggaagttagcctttatattgaattttattcaacatgtacaagaaatgcttaattttattaggctaatattataacaactgtagaaataaatatctaattgatcaaaaatgccctttagcaaagtaaattggtcttgaagaatagagcaatcacataaaaatagaacttaaaaattccaagtaggtttgaagttgatcgatataagcatcacgctcctcctcgttatgctgctatattttgtggaacacctaccacagataagctgtctgatttaggagaaaaaaattaatgtcattcaccaccaacagaaatgtgcttattctttcaaaatgattattgttgctgaaagtacaaatgtattgtattcagagttgccataaccacagtaaggagttatgttgcatgatgaatgtgtttttttattagaaaaaccaagaaaaggaaagtttgccatagcatttcgctgtgtaaattagaatcagtctttccattgggtctggaatgtctgaaatactttttttcctaatttgagtaatgttttgtgatcataggttactcttacacactatagccttggatagaggtggttcattgttgtcaaaccataaagcacacgaacagtaatggtacccagaaaagaataaatatttcagaggtttgtgaaaaatacaataagtacattttagtttgttcgtggtctttacttatcctagaccttttacaaccaaaatgagtcatgggacttttagaaggaaattgtcagtgttaggttttgtgatggtaatgcagcaatctccaccttccatgatgcagcccatgcttgggtatgagactgtaaggagtcgagtttcattcacctacatgcccaaccttagcctgattagtaaatcctccaccctgaggaagaaatgttcattggtgggttccctacagtgacccctgtgctgctagggaagggatctcatctgcatcccacaccatctctgccagagcatgacagaataagcacagcacaggaacacaaggaggtgaccaagcgggagggcaccttggcagacaggctacctcatcagtagaggagacattggggtcttcagcatcactcaatcctgtctctatttgtgagtgtaccttgtcatctttgctgcatttggggctggccctgtcattagtatttccccaacaggactttgaaagtcatagggatttatattttcattcttaagtactatttccaataaaagacttctagatttcttagggaacatgtggttgctctactttaagttgaaaacagatatgtttatttaatggtagtcagtagaattatttcctttgaggggagagccataaacctgagttgctgagagtgattcttaaatgaaattcactttgagacttggccagagcctgttctggccattgtaaaccacacactaaacacatttgcttttttgctggttttaatattgacagaaacactgactgggaatcgctcttccttaatgcagttgatccttcacttttttgcagagggggccctgggtgcttaacggaagataaactggaaggatactgagtggggtctgaccagcaaagcactgtatgcagtaaagatttccactgacaacatccaagatgggctgacattccttgtgcccagtggccataggactggacctttccattggattacatgacatggccttagcagagtccacagttgccttgattgatgacaaagtcaagcagacaagccagcaggtcatttcagcatgcaatgaccatcagtatccattatttggactatgtaataatctttcaggaacactgtaaacagtggtattagacctaaataactaatatggttttaataaacctaaattactatttaaacttaaatagcttttaggtattcttgacatcacttcttgatgtctgtcaggtaataagttcccacgtaagaatataaagctaacgtatcctcttaaacctttgtttccaaaaccaagagcattttactgaaactctaatatacaggcaagttgatccctcattaagccatgtgttcatcttaacagatatgcacatatttttctaatacagaaaccagtttcctagactaattgaagatccttgcattgaaggtaatagagtcttattatttgcattcagtgtgaactgtaaaatccaagtcattagagaaaacaagaatatgcttctctttcaaaaaacatcaagcatgttttatatagtcttagttgcaaatttccatagttactatgtagtgaaggttttctgaaggagatgaggattcttcagagcaagggttcagttaactggcatctggaaagaaccaaccttaattctaaatcctaactggattttcagaggccattctgagggtagtagattttatctatgaccttgtgtgccagatgtttcattttatgttctcccttatttacctgaaagtgatgatgggcaagggaggcatatgaaattagctgactaatgataacacgtgatcaactacaggcttcatagctgagataccccaaagggtttaattaggatttcctgccaatctgagatttggaaagtgatttgggataacaaaacaaacacatggaaacagaatgtgatttaaagagacgactcacttaagtcaccagtctccaacagaacagaaccaatgttgcattatcccagagtgaactgagtcacctaacagcccagaggccagcacgcaattaaagcttctgaggtgctgtgatctgaatgctggtgtcaccccagaattcatatgttggaacctaatacccaatgtgataatattaagaggtagagccttttgggaagtgattaagacatgagaactccactctcatgaatgggattagtgctctcataacagatgttgaaggggctgccttgtctcttccaccatgtgaggatacagagagaaagtaccatcctggaagcacagaatatgccctcaccagacacagaatctcctggggccttattcttagattccccaggctccagaaccatattttgttatagcagcccaaatggactaaacagaaaacatagacaatgtagggcaagcgtaggtcagtgatagagaagctttgaagcaggaaggaagaatgtgggatggacagtgagtgaggcacatgtagggaatggaggtagacagcatcatccagggtacattacaaatcccaccatcatatgtaatctgccattgttcagtgtgaacagtcactgagcatcagaagaccttgatcctattcccttctctactttggagcaagttacaacatcatgggcctcagtgttctcatctaccagataagaggatcaggcccagataattgtatcagttcttattcattttgtaaatattttatgctatgccccagtttttaaaaatagaatatgtattagtcagccattactgcaataatgcagtgtaacaaatagcccctgaatctaaaagcatctctctctcttgctcatgggtgctccaggtggctggatattggctatgctcaaccggtttaggttggacttgcctccaggtaccagattggtccagattggccctacttgattctcctctcccttatgctagtaagtatgtggggttttctcttctcaggcagatcacagcagtgtcagagacaagccaagccacacaaaaacatttaaaacctctgttccagacattctgctatcacgaccttggctgccagttacatgtcggactccaaagtcaacagccctgacaagtgtacacctcataccctcagggaatggcaaacagtgggaaaaatgatagattggccacaatctagtatcctgagtctccagttttagttatgaatcctctcttgaacatgttttagaatatttcaaagttgagaaaggaaagtagcccctattaatgctggaaagacaaggagggaaagaaaagtaaaagcagcagtttttcctctattattgcaccttattccttgtcttaaggaaatccccattttgcacaagattaggttatttaagtgtttttcttcacttactttcttctaaattattggtgaaaatactaagttcacagccagaaagcttgacataaatgcctgtttgtcaactttgtaaagtggataggaatacaaatatgatgtagagctgctgtaaatctggtagaataattaaaactttaaaatatttcatttcatgtcacttgtaatcactacaactgtaggaatgatgtaaagcagagaaaataggacccatcttacatctgctagtgtttgttatgaggacattacctttcctttacttttttaaaaatttcaccagtgaaattatattgaccaaatgaaaactcatagattactaatgtgaatttactatttaaaaataatgttgaactcatattggacataacaagtgatgatataaacctagattttattttgatcatgaaataacctagtcatgaggagtaggactgtggaaacctggcttccccagcaggaacacagacgggaacacagaccaccatgaatggaatcctgtaatccatctgcagcttcaactctttaactcacaatgaagccatatgaacattctctttaattaagagatgttacagttttgtgagatacaaaatactaccgaaataaagaaggatttcaacgtctttattgacactctactgcagcataaatggatctaccaagtagggtacattatgcagatacatgcccatagcaatacaaatgttaattaaaaccttgtttaagatttctattttggaatgagttagcatttcatgctggtaaaagaaattgattaagcgaattacataaattagccaatactcagaagatccacatagccttcctgtcactaatatagatttttatcaacacgatatgatccacaggtgtgagagcaaacataacaaaggaaataactaagaaatctgtagtggtgatttctgcatctcgggaacttatcatctaatactttataacaagaacagttatactctctcctctgctattttgtatgcttttgtttcatgtccatccacacatgcatacacatgaacacatgtaccggggaagagagacaaggttcacagatgtatcctgtattatttccttcattaagggggcatgttccagttggagagtctaaacattaataaaaaattaactcggccaggcatggtggctcacgtctgtaatcccagcactttgggaggccgaggcgggcagatcatgaggtcaggagttcgggaccagcccggccaatatggtgaaaccccgtctttactgaaaatacaaaaatttgccgagcgtgatggtgtgctcccagctattcaggaggctgaggcagaagaacttcttgaacctgggaggcagaggttgcagtgagccgagatcgtgccactgcactccggcctgggtgacagagcgagacccaatctcaccaaaaaaaaaaaaaaaaacaaaaaaaaaattaggggtcttaatttgtatcatattctttttataaattattgaatacattggtagtacatgtttattattaaaaggtagcagataccttttaaatataaaaaaattaaatttaaaaatatttaaatttaaaaaactagtaaattttaaaaaataaaatcactctgatgtcaccatgctaagatggatactgtgaccattttgacctcaacatccagacttctctctacacatatgcatgtaaatgtatatataagttatatacacagatattttacatatataaacttaaacaggattgtgcagtgcctaacattttataatgtactctttgattcaacaatatatgatgaattactttctgtactaagaaacatttttagggaaactcattctttcagcaaatatgctcggtttctttcaatatacccccttggatgaagttgtaattgtttggttgtcttcataacctctaccctctggatctataatctagaagagaagataaacattagttaagtaaacaaacaagtggatttcttacaaatagtaagaaatattctgaaagcaaaataaacagtgtgcaatgaaaaagagcagtggaagaatagaagcatgaggaggaaatggagatgagttgccaacaaactcagaaatgattccatcatggggtcccatggcacaaggatcctgagcagagggcattggtcagcgagtagatgggaaaagatgcatgcacagaagcccagtgagctaagaaggaaccagagaaataagtctggggttcatccagggcttggtagggcaggtcaagggtttaaattttatcctaaagtttgagtatcttttagacaagagaaggaaatgatctatgtttggaaccagaagttcattgatgattttggcaaaaggatgcttagaagaagtaggagagaggtagccaatttgaagggtgaatggtttcataaatttatggtgagggatctgccttgttaatccttctcatattgtggaatatttagcatctattgtctttggtaccaaaacaaaactgaagagaatgatggtaaatatctatatcttggataactaagtcacaatgaataatcctgcttgttagaggcacatgacaactcacacatggtcaacgctctatgcttattcggcctccagggagctagaccaagggaaagacttacaagaagactacaggatggggttgaggggtgaatttcagggggctaaataaacaacaaggctctgtcttcttgggtcatgtcttccttggtcggctctcaagaaagatgatcctggcacttcctccttcttggaacctgggctctagggtctagatctggtctacttggcactcagagacagacactcccttttccttcatattctatgtgtttgcctcagggtttaccatttcttgtccacagactagtagaaactgaagatccaactgagtaagcttggggttgggggaaagaagggctgaataggtcccatagcctgcatccagtgcagaccccaaacttgcctgaagtccattaagagagtgtcctcaaagctccaggtggtccattctaataacattgatgataactgtattaataataggactagctaatacacactgtaagtgctgttcaatttacatatgtcaactcattccatccactcagcaacctcatgtggtataggtcctgtcatatggggtagccctgaggctacgttgctcagtgtcacacacagccaagactcatgtcacacacagccaagactcagacctgggcctttggacttcggagtctttaacatttgtgattacccttcttctatactgtctctttccgtgtctgtaagtgctgttcagtttccacatgtcaactcattccatccactcagcaacctcatgtggtataggtcctgtcatatggggtagccctgaggctacgttgctcagtgtcacacacagccaagactcatgtcacacacagccaagactcagacctgggcctttggacttcggagtctttaacatttgtgattacccttcttctatactgtctctttccgtgtctgtaagtgctgttcagtttccacatgtcaactcattccatccactcagcaacctcatgtggtataggtcctgccatatggggtagccctgaggctgtgttgctcagtgtcacacacagccaagactcaggcctgagcctttggactttggagcctttaacatttgtgattacccttcttctatactgtctccttccatgtgtctctctggagaactgccactaggttgaacaatgagtcagatgttcaaagggctagcatcatggatgctgatcacccaaatgctatctcaccatggccactgacatcattaatgtgcagatacatgttcctacaactcattcagaagacccaggttgctttacagtcacaaaatacttttttgtaaatactgtaaattgttgaggacattgatcctccctgatttggactgaggcacagagcattgggaaggggtccagaaggtgatatggtttggctatattcacacccaaatttcatcttgaattcccatgtgttgtgggagggacctggtgggaggtaatttaattatgggggcaggtcttttccatgctgttctcgtgatcttgtgatagtgaataagtctcatgagatctgatggttttgtaagggggtgtttccctgcacaagctctctttgcctgctgccatccatgtaagacatgacttgctcctccttgcctgccatcataactgtgagggctccccagccacgtggaactgtgagtaaattaaatctctttttcttcccagtcttgagtatgtctttatcagcattgtaaaagcagactaatacagaaggaagcattgggctttagcatggctaggcagctccaatgtgtgcatgggactcagatctcagccacttctgtctgaggttccgaatacatgcttcctaagtactcagtgctgaattctttctgttcaaacatctgaagtgttgctagtcctacctttatagaactatgtttcacttaaatctgttctacctttaacttgactttctgacttcactccagttccactgtattaataactgaacagtgggatccaggcctgatctgcactggaataacatttttgcacagggatcttttaaaagtgatttaagttctgattctgttttgcctgtgtatatgttgtggaactaatattaactaatttattgagtactatttgcaagacctatcatagctgttttgtgtctagtttctcccttaatcctcacaacagctccatgatacaggaggtaatattaatattcccattttggaaatgagtaagctaggacccagagaggttcagcaatttgcctaaatatgcacagctaatgggtggtaaacagggatgttgcttgcacctatgacaatggtgcaatagaaaagggtacttctactttatgatacctcactttcatctgctgaaaaattattgaaatatactggttttttaagaacatgccactctatggctaccttccagaaaaaaaaaattgtaaaatttataaatctaagatgtcgatattggcagtgtgcttggcatcccctagagtgtgtaggggtgaaatctgtgaatccaactccaggaaccaagctctcagcatgtatgttacagtgcctcgtgagagatgaaaggtctgctgtttttcaaaaggtgccagaagacaccctcattttggagagcaaaaataaattatctcaatcagtcctcattccttatgttgttagcatcaaaagaaagctttttctcgggccaacatggtagcttttactcagagacactgtgtgcctattaccagcaatgataggtccaacaactaaatgttgatgagaccttggaccttgaggttggccaaggccgtgctatgattgcaagattcaatttggtgccatggtttgtgaggcttacaaaagtgtataatgttcatttgctttatgtcggattattgcactttctcatttatttaactccttcacttaccactcattcattcattcatcaacccaatcattgtttgaaagcctactgtatatcaggaactgttctagacctccaagataccaagattaacataacacatgatcgttgcatctatggagtttatattctagaattgttttactttggacaatatcacaagctctattttattgagtgtgatcattaaattaggataccagatcttagggttgaaaagggtctcaaaaattatctcatctccttcattttaagctcaatgacaagtggcatcctcaaggtcacacagtctatggcagaatacagactcgatgctgtgtccccagactcctggtcctgggtctgctgctactgccagaaacttcattttaatcaggtgttggtgtcagcatacacctggtggcgagcaagaaggcagcttcaaggtcaatacagggtaggacatagggtcagactgagacctgtgaggctatgagatgaacattgctgcaagccaaatctgagagcttggcctcaagggcctgactgccagtgccccagttctggctcttcttctttttttcttttgtttttttgagactaagtttcactctttttgcccaggttggagtgcagtggcaggatctcggctcactgcaacctctgcctcccaggttccagtaattctctgcctcagcctcccgagtagctgggattacaggtgcccaccaccacgcctggctaatttttgtatttttagtagtgacggggtctcaccatgtgggccaggctggtctcgaactcccaacctcgagtgatctgcctgtcttggcctcccaaagtgcagggattacaggtgtgagccaccacccctggctggctcttcttttaaggtctgtgaacttgagtaagttatttaacctctctgttcctcaatgcctcccttgcaaaatagagataatcataaagctggtctcacagggttttcactaagattatgtaattgctcatgggaatcttcatacttctcccatggttggtgcttggtgaagcttggctattgttattactattattagtagtagtattgcctctgtgactctgtggacaccttggtggagccccgagcttagtttcttgaatcccccttgtgattcttagagtggcaattcccacagcaagtctccccttgcttgaaaatggtcctgaatgtgacccaaacagtgaacatgtcacagagcctgtctacaccccttctgaagaaagccgcctgtaggtcatccatcaaaataatcatttaatttcacattcctgattttgatccttttcaggaatcctgaaagtgaattcctaccttttcagccaaatgtaatctacttcctgtgttttcagccaccacatctgattataggtatgtggcatatctgcagtaagtgtaacacactatttcccaaaaagaggccataactcacatgcagaaccaaatccttttggaaaacagtatatgcccttcccagaaacccaaaatttacaataacttattaaacaccctggagggtactgaggtaataaaatctaaattctataaattgattgtttcagcaagaaacaggcttccaagctggcttcatgcatgcaggaactctatcatcccaaaagactgtgctcttagaaggacccagtgcttgacttaatgcgctgctgttttcgtcttgaaattcttaaccattttttaacgagggcggcctagtttcacttggcgagtccttcaagctttgtagctgttcctgacacccctcatcatatcccacagaactggtgttctgccaaacaagtctcaggtgagacccctgttgtctgttttctgtcatctgggtcaataagagacaaactcagtggagagttaagaatctatcttaattgttaaaaatatgcaccagatttcctaatctaaatgtatgtgcacacaccactagatgccagcatgaaccagagctgctgaattcctgttcagagagaattcagctcagccttgttttgagaagttctaggttcttcccccagaggactatgatggggcaacttaaacccgaaaatactgttcaagtgtaatttgtgtaaactaaccatctcagggggaaatttttccatattaatctttgtgtaatttctgaattataaaactatttttagatgaagaaatacatcactacaattgatacagagacactttaatttaattggcacaaaagtatgttaaaaatattccacagtacagatgctccctgacttatgatggggttatgtcctgataaactcatcctaaattgaaaatatcttaagctgaaaatgcatttaatatgcctaacatattgaacatcatacttagcctacctcaaacactcagaatgcccacattagcctacagttgggcaaaatcatctaacaagtccgtcttgtaaaatgtgttgaatgtctcatggttgtttttcttgattccatggctgactgggagctgtggcaccctgctgctgctcagcatcatgagagggtatcatatcacatatcgctagcctgggaaaagatcaaaattcaaagtatggtttctattgaatgggtatcacttttgcaccagtgtaaagtgcaaaaatcctaagtcaaaccatcggacaggaactgtctgtataggtaaagggataggcatagagatcagtgaaactgaatagagaacccagaaatagacccacacaaatatgctcagctgatttttgacaaaggtacaaaagcaattcaaaggagggatgatagtcttgtttccataaaacagtacaagagcaattggatatgcataggcaaagaaatgaaccttcacctaaatctcatagcttttttttttttttggtagatacagtttttaaatttgtattatttattaatttttaaactttcatttttaggttcaggggtacatgttcaggtttgttataaaggtaaacttgtgtcaccagggtttgacataaagattatacaaaaattcactcagaatggatcccaggcttaaatctgaaatgtaaaactataaaatttgttgttttgtttgctgcataataccaactaaattaaacaaacattagagaagttgaaagaatgcaaggatttaataaatcatctagcaacaaggctgcactttgagcagctgcgggctcacaggattttcctttaagccaagaggattccgcttggcagctgcggggcaaggccactggtgtgccacgccacctcacaccgcagccaccagacttcagaactggaaaagggtgattccggggtaatctctgccacctcctgcctaaggagagatcttgtccgctccctaccatttgtctatcactgatcgattccattattggaaaactttctagagcacttgttggggacaatgtaggtctttcaggataggatggcctgtctcaaaaggtcatcctagggccatgttctttcttcgtttcctacttgtcccactcaacaaacaaggctaattgtggctacctctcaaggctgtgaggaaataatcattcatagctgaaatgggtcttgtacatatcagtgattgtacattctccccaatatctggatttagtgtctaatcgggtgtttttttgtgacacatgttgtattgataatgatcaatataggtttattgagaataacaaataattacacaaattcaaaaattattttccttcattatacacagggcatatcaggactgctttttgcaattataattgaggtgctgctgcattattttgtttaattatttccacctgatggcctgattaggaaaattgctcaccttgttttcctagcataatgcaccattatgagaagcaattactgcagcctgtgtccccagcccccaggctgagctaccatcctacagtggctaccatcctgtagtgtgcatggtcttgccagcgtccagatagagtttgagttcagccatttgattctaagcctaaattcaaataatctgtttttcaagaaagggttttgtttaactctaagacactggaaaggtgatgtgtgatttctcatttgctgatgtttgacgccgttgttggcgtctccgtgttggcatgagcacactgctctctgcctccatgttgtgtgttcacacctgctctggctgtacaagctgaaagggttaaacgtatcctgtcctggtggactttgtgtggcattaatgtttgagaataagtgtgctctgccaccacgtgatcatgtgtgtgtaaacatgattaaaaggaaaatggtgatgacaaggctggtaaggaaagttgtggaactgcattaggacaggcagccatgcgagggccagaatgaaatacccagtttggaagaagaaaggcggtctagatgccccttggaagtcactggcccttcccaggtgaaaccatgtggtgtggactccagctgcctcaggtgacatcgcccaacgcaggtgatattatccacttcagatgacatcgtccacttcaggtgaaatcacctacctcatgtaacatcatctacctcaggtgacattaaccagctcaggtgatatcttctacctcagatgatgtcatcacctcaggtgacctcatccaactcaggtgacctcatccaactcaggtgacatcatctacctcaggtgacatcatccacttcaggtgatatcatctacctcaggtgacatccacctcagatgatgtcacctatttcaagtgatgtcatccacttcaggtgacattgtgcagtctcttgctagccatttccctaaactggaagagagatagaaaaaaataaatcctacctctgccatccgccaacagtgtgaacaaatccaactctctccaagcttttgttttcattccttaataattgaattataggaaaatcatcttcaaagaaaaatgcagtcccgtgcaggggttggagatggggccagtcaaagcagaaggagcccatatgaacaggcagatgttatgctttctgtgttggtcccgtgcagctggtgcctgcctgctgcaggtgctctttttttttttttttttttttagacggagtcttactctgtcacccaagctgagtgcagtggcatgatctcagctcactgcagtctccacctcccgagttcaagcaattcttctgcctcagcctcccgcgtagctgggactacctaccatgcccggctaattttttgtatttttagtagagacagggtttcaccgtgttggccaggatggtctctatcttctgacctcgtgattcacccacctcagcctctcaaagtgctgggattacaggcgtgagctaccatgcccggctcattttgacaggtatattaatgaatgaagaagaaatgtgactgattttttttgtatctgtaaattgcttataatttgaaacagatagaaaatggttacaacagaaatgttggctttcacagctgggaaagaagaacaaacgagaagcgatgggtcaacctggttaagagagtaggtttcaggctcagacttccccaggtgcaaacccagctcagctaccgtggaacctgggcacatgacttcaccctctgggcctcagtttcctcacctgtatgacagagattatctcacctaagccatataattgctttgagatttagtaagttgatgcatgtcaaaatgaagggcactgactacttttttcctttactatatctattcatagctcatcttctggcttcgttgatgaaaaggggcatctattttagggcaagataattagctgtgtcctatatgataggctgaataatgccccattcaccaaagatgttgaatccgaagcactaggaacctgtgaatgttactttacgtgggaaaaaggactttatagatgtgattaaattgaggatctttggaagtggggaggatatcctagagtgtttgagtggcatctaaaggtaaccccaagggtcctcataagacagaggctggagggccgaagtgggaggtggtggtgtgaggaaggaagtggagatctgagtgatggccaggagctgagaaacaccgcagcctctggaaggtggaagaggcaaggaacagattctccactgaagcctctggaaaaaacagccttgccaacaccttgattttagccttttgactatcagaagaagaagatatttatttatttatttatatatttattttttattattatttttgaggcagagtctcatgctgttgcccggactgaagtgcaatggcacgatctcggctcactgcaacctcctgggttcaagcaattctcctgcctcagcctcccaagtagctgaaattacaggcacccaccaccatgcctagcgaatttttttgtattttttaatagagccggggtttcactatgttggccaggctagtctcaaactcctgacctcaggtgacctgcccgccttggcctcccaaagtgctgggactacaggcataagccaccacacctggccagaagaatacatttataagagaatcagtttctattgctttaagccactaagttggtggcaatccattacaatagccacaagaaactagtacggttgactctagaaaaatgcagcagttggggtactgactgctcaggcagccagaaatctgcatataacattttactccccaaaacttcaatatagtagcctactgctgactggaagccttactgataaacagttgattgacatattttttgcattatatattttagatactgtcctcttacaataatcttgagaaatgaacacattattcagaaaatcataaggaataaaaaaatatgcttactattcattaggtggaagtggatcatcataaaggtcttcgtcttcatcatcttcacattgagtaggctgaggagtcataaaggtctccgtcttcatcgtcttcacattgagtaggctgaggagtcataaaggtctttgtcctcatcgtcttcacattgagtagttcattaggtggaagtggatcatcataaaggtctttgtccttgttttcacattgagtaggctgaggtgtcataaaggtctttgtcctcattgtcttcatattgaataggctgaggaggaggaagggggagaaggattcatctcaggaggggcagaggcagaagaaaatttgtgtatcagtgaaactgcagaaacttgggttgttcaggggccagttgtacaccccattacatgagatttcaattagtttagatggaagtttttctgaaaatctttgcataacatcagcccttttaaatgagagataatgaagatgtggcaggataactatttttgttctatttatcttcgcagagattctgtataacatagagatgctccatattctcagactgctttgcttttcgaattgctggttttcatttgtaagattttgcagttgtttttctccctctccagctgtctcagtagcggcttctctctcactgctgcctccacccttaccaccttctagttgtacagctagagaagaagaatgccggtaaagatgtgtgaagcacgtgctgtgtgttctgcctcaagtgcgtcgcacacggtatctcatttgactttcccaaaacctctgtttacagattgtgacaatgaggcccaaagaggcgaagccggcagtaaagctacacaggaggaagatagacaggagtccagcggtagagccagggccctgaaaaccactcttcactgttgtattaattggggttctctagaggacagaactaataggatagatatgtgtgtatatatataggggagtttattacgtattaacttacacaatcataggatctcacaagaggctgtctgcaagctgaggagcaaggagagccagttcgagtcccaaaactgaagagcttggagtctaatgttcgagagcaggaagcatccagccagggagaaagatgtaagctgagaggctaggccagtccttgttttcatgtttttctgcctgcttaatatttgctggcagctgattagattgtgcccaacaaattaagggtgggtctgccttccgcagcccactgcctcaaatgttaatctcctttgtcaacaccctcacagacacacccaggatcaatactttgtatccttcaatccaatcaagttgacactcagtattaaccatcacagctgtctctacatcaacttgtagaaaacattgtgttgctaaaactgtacctaaaatagcactgagctaggctgtgagtgaaggtatgaagattaattctccatcaaatgcaatgtgcagagtgctggattttagcaagaggtgacaagcagcgaccagccccctctatgtgtgtgagggtactcttcagattactggatattaggaaaaattattttttgttcatttgtattttacacaaggtcttaatgacttttaatagagttgctctgaaggctcttttcttggtcatttttaaggagatattagtaactttaattcctatgacccaaaattgcattaaggaaagaggtcatgtcttattatattttgcatctcaccatctggaatagcgcccagcatagaaaaaatccagaaagtgtttatcaaataagtaaaataagtaacatattctggagtacttaataatagccagcacttaatgagtacttactgtgtgccaggcagtaagccaggtgctgtttgtttgtattaactcatttaattctctactgacattataaggacctgaagtacaagggcgtttaacaactttccaaactacaagtggcagccctgagctgggagcccaggctatctgggtccacagttcacactttaaaacttgatgcaggctgggcttggtggctcatgcctgtaatcccagcacgttgggaggctgaggcaggtggatcacctgaggtcaggagtttgagaccagcctgaccaacatggagaaactccatctctactaaaaatacaaaaaattagccaggcgtggtggtgcatgcctataaccccagctactcgggaggctgaggcaggagaattgcttgaactcgggagacagaggttgcagtgagccgagatcacgccactgtactccagcctgggcaacaagagtgaaactctgtctccaaaaaaaaaaaagcacaaaaaacttgatacaatactgcctctctaaagtccataaatgtaacatttaaaattatattttgcaaaagacattttgcaaaaaattggaaatctgcagttgtgtttgcaatgaaaaacattattatattttgttggtgccatataataacattgaaaatttggatacaactttaagcaccatgggagagcaaagattatgtcttgttgccagttcatctcccttgcctagcaagctcagagcctcctatacagtatgtactcagtagccatgtgggggctgtcaaaagtgccatgctgcaaggggttacagtgatgcttgaaaaagtacctaaaatgcaaagttttcatacactaatgcaactttcattatattttatattcctaaatgaaaggagtcacatgaaatggtgtgtgtgtgtgtgtgtgtgtgtattaggtcgctgtatgataaaggaagtagaacgatatcatgtcagtggtcagctgggacacaacatgcctatgcccagggcagcggccagctgaaacacacagccccacgacactaaatatggatatttgctctagagggaattagtaaatttgcatatcctgtttggagatagttctgccttctcgtttagtttttgcttgtcttagactctataaaagactcataactgcagttcaacaattgataataaaatagtatttgcagcagtgtgtggtggctcacacctgtaatcccagcacttttggaggctgaggcgggtggattacctgaggttgggagttcgagaccagcctgaccaacatggagaaaccccatctctactgaaaacacaacattagctgggcatggtggtgcatgcctgtaatcccagttactctggaggctgaggcaggagaattgcttggacccgggaggcagaggttgcagtgagacgagattgcaccattgccctccagcctggacaccaagagcaaaactccatcacacacacacacacacacacacacacacacacacacacacacacacacacacacaaagtatttgccctcatggtcacacagttgaggccagcgcctttgttgggagaatgaagagtaagtaaatctcaggtaaaatattagggttaagacagatgagctttggtgttgaacatgccaagcctaaatttcagaaacttaaaggcagattccccttcatagtagatcagactggacctggactgtgaggacagacaagaaagatggagctctcccagagcgaagatgatacagtgtagcacaaagtataatgggtcaaggtctggaagaatttaggatcaaaattcagctgattaatcagtatcatttgggaaattccctttaaaaaaatggggctttctgcctcagtgctgatattcatccagaacacaatacttaactgacctcaactggatgacatcttcaatcaaagctcacaggaagacatagcagcaccaggccacatgcggcaggcagccgtgagcatagcctccctagcttgtgtctggtttggtttgatgcatcaggatgagaatctgcagcattcttccaatgacaaagccaatggggcagcttatcctctccctaactctttccctgtgtttactgtgctgtagagattttgcataaagtgctgcaaagtgggtagcaataagggagctgaggtttcattcacagagggaaggccagggattctgaatgttgactgcaggtgggcattgtgtttggcaaatctcttctacttgaggtctgaccttagccttctagactctgaaaaacgatcctgatactgacccagattggagggggtttggtaattctggttcatggtaacaaagctcccattaacctattgaacaattgagtttgtcagtatatgaatggcccatgcccagggccatggtcagctgggacacatgggttcatgccgagggccatggtcagctgggatacacgggttcatgcccaggacagtgatcagctgggacacacgggttcatgcccaggacagtgatcagctaggacagacagccccattccaatgacagtggtctggtcagctgggacagacaggtccatgaccagagcagcagtcagctgggccacctaggcccctctcctgtatgccctgctcgctgtcttcaaggctcattgcagagagtgctgtggccagaaggttgcttggtgagcctggaatcagaacactcaagcttctggtatctcagacggctgacagcatcaggtcccggggctgacacctagggagctgcttattataccccctgtaataagtattcccacaaatagggatagtacccttgcacactagatttttttttcaaagtgttagccaagtaccaatgaagaaagagcaaatgtgagccaagatgacggtttgggcttgactgaggagaatgactgtggacattgtcctgtgtgtgctgctccaaccccccagcccaaatgacaccattcccattgtcatgtttgctgtggtcactagctggtgctcctaggaagcacacaacaaagcttgctgggcctctttcctaggctccagccctttgagttatgcctctgggaaagtatcttgtacttttcttcatctctcatgtcatagtactctctagaacacttatcttttatgacattgacatctaaaaacaaaataaatagtgaaatgtggcctttgacaactttaatattgccatttacattatgaacctttaacaatttagaatgtataacgagatgacaaatttcctatttctgaaagtagtcacagatgcatagtagtatagacacatagatgccgtgaactgttcccacagcaggcaacgtccactcgtgaaaatgcccatagaccacctcgccaaattactgaatggccaatgaaaggacaaatggagagaaaaggaagcagcacaggttttccaacaaactgtccatggatcttgtaaagtgacaacatttgtgaccattgtaggcagacccatctatgcagcttctgttaactgtgacagcagtcaggctagtttaggaagtctgcctcctgcttagctagccccagggcacaagcccctgacaattgtgcctggctttgctggatacagtccagagtcggtcttttcttccagtgctaccaatggagtagtatggggccagccacaccctctgaccccaatccatgtgtgttcacaggtgcaaatttaacaatcaaacatgagatttggagaagctcttgattgaccagcaagcaaagtgaaatttactgaaaagtttagcttcattgtcctttattctgccccctacaaaaggatattatatatagatagatatccatatatacatagtttattcatgttcacatatataacatatatagttaacatgtgtatgtttatatatgtttatggatacacatgcatgtgtgtgtgtatatacatgctgaaggtggattagaaactataagattggaagtaaatatattctttagaattatactaaaacagaaaaaaagctgtatttttgtttttaagtttatgaaatgaacaaggaagagtttttttttttttttttttttggacaccgagtttcgctctttgttgctcaggctggagttcaagcgattctcctgtatcagcctcctgaacaactgggattacaggcacccgccaccacgcccagctaatttttgtatgtttttttttttaggggggggtaaaaaaattcttatttatctatttattattatactttaagttctaaggtacatgtacacaacgtgcaggtttgttacatatgtatacatgcgccaggttggtgtgctgcacccgttaactcgtcaaccaaacaccgcatgttctcactcataatttttgttatttttagtagagacggggtttcaccatgttggccaggctggtcttgaactcctgacctcaggtgatccacccaccttggcatcccaaagtgctgggattacaggcatgagccaccatgcctggccgggaagagaattttaatctcagctacatcattatcttttttgatcccagcattcctttatgtaacccaaaccttggttctgttttggagttgtagcctcaataactgtaagagattaaacttctgttgtgataatttttgtttgttttttgagatggagtttcactcttgtcacagagagtgcagtggtgcaatcttggctctctgcaacctccaccccccaggttcaagcaatccttgtgcctcagcctccagaatagctgggattacaggcacccatccccatgcccagctaatttttttgtatttttaatagagatgaggagattcaccatgttggccaagctggtctcaaactcctgaacttaagtgatctgcccaccttgtcctcccaaagtgctgggattacatgtgcgactggcctgttgtgataattttttgtggaaacccccaggaaactcacacagcttatttagattaaagataagaaagctatttccagaatataatctattcccagaatgtcatgtcctcaggcatatcgttgttgaacctttgattatattctggaaatagattttttatctttaatctgaagtaaattgtgtgagcttcctggggattccataacatatgaccacaatagaagctgattctctcacagttctggagcttacacctccaaaattcaggtgtctgcagggccatgttctccctgacagttctggagaggtccttgctcacctcctgcggcacctggcgctggctggcaagccttgctcttgttggtttgtattatagacatcacgccagtcacacggctggcttcttccagtgtttttacctcatgttccctctatgggtgtcagtgtctgtctccatatttctccattctataaggacaccacttatattgaactggcacccatcctaatggcctcatttaaatttgattatcactataaagaccttatttccaagtaaagccatgttttgagatactgcaggttaggggtctgccatgaattttggggggacgcaatttatcccatgacttctaaattagaaaataaaagaaatctgttttaaaaggtacgtcatgctgctaggctatctgcaaattaacagtgttccaaatcttggtattgatgtttgcaaaatttaaaaataggacaattcaaattttaccttcctgtttttagaaatcatatttttatattagcttatttattaaagtggaaaaccgatattagctatatataaaaagagaaaggataataggaaagtgaggaaatataaaattttgtttgtaatatttctctaaatgtttatccagcatctccctcttccccacacccctcacagcctccgctcttggatttctgcccattaagactgatagcaggaacatctatgaaatgccattcataattaattttgttacatcactgatcatggcccacatgtgttactggtggatggtatctgagttaccggcagcgaatccatatggctctatagcaacaccaattcttgcctcctcagaggaaagaattcgaccaaggggtataaggcacaaaaagagactgaggcaagtttcagagcaggagtggaagtttattttagacagctttagaacaggaaagaaagggaagtacacttggaagagactgaagcaggcaacttgaaggacaagtgcaatctttaaccttgatcctaggactttgtaggctggcccacttcaggtgtcttgcacccctttcccatgactcttcgcttaggacgagcttcccgcatgcgcagtgccctccttccccttgggaggtgagcatgcgcagtgtgtttaggaagttgtaacaccgtttacatacatgttctcaatctctctctctctcgttgtggataatgagtcagttaaaaattagtaactgtccttgttaatgaaaacctacctacattaatacaatacttctgttcaaaatattcatcgtgactcaaaattttgggaatgaatatatttgctgttaaaatgcttctagatgctcgcatatgccactgcctggcaaagtcagaagagggtacataaattacccaggcgataccttctatgccctctggacttttatgccttgttagtgtctaaggttacagaaaaaagaaatggaacactcgggttgccagggagacatccaagcctgtcaacccctctagctctaatagtgacaaatggtacttattacatcaggactaatttcattggattctgctcagataaagatacttaacctttactgataaaattgtgtcgttataattacttagtaaaagaccttattaggcaatagtattctatgtggatagacgaacattttattgaggttgattacctattacattgatggaatatttgaatgtatgattttctgcaagacctttacttcttggaaaaacctgcagcaaagagattttggttttgtggctgcctcatatggaggaagtttaaaaatgtggtttttgcaagttgttattgaaaatccagaaaaacaacatatacattttttaaaaaatagactttacatgtcaacttttttgttgttgttattgagacggagtctcactctatcacccaggctggagggcagtggcgcgatcttggctcactgcaacctccgcctcctgaattcaagcaattctcctgcctcagcctcctgagtagctggaattataggcatgcaccaccatgaccggctaatttttgtatatatatatttttttttagtagagatggagtttcactatgttggccaatttggtctcaaactcctgacctcaagtgatctgctcacctccgcctcccacagtgctggggttataggagtgagccactgtgctcggccaccaacttttaaaacaaagctttctatccaggcacataaaattaaaatatccaaatatgtcaacgaaccttttagacttttagggtatatgccctcgaaggccaagactggaaataaattacattttgaatgtcagttccatctgactggtagtgactgcctggaatgcagaactgagaaggattctgaagtcttatctgtgctcactagaaaagagtgtagtaattgattagcaatgtctgccatgggcatgagcaggacatgcatcagtggatatgctcataattgccatcccttgtctaagtttatagaaagatagcagttgtgtcaatgaggcattcagtttaaaagagccttttctgtctcctccatatgcattacatgctcagagcctcctcattctcagtttgtcttaggcagggaaaccacagccctataggacatttctcaaggttggctctgtagacctcttctaagcaccctcccctgcagggcacctgggaaaagaaatgtcctctcccaaggagctatttgtttcaacactgtcagagagaaagtcatggagatatttgtcttaaaatccaagtactttttgtttcctttgtccattttggtttccgcctctcaggtgttaattctgctaaaatggtgattgataatactgttgtttatctctcctgagagccaaagatatgccccttgatggcggaaattcaaagactgtgagaggcagtaaaagaaaggctctgggacagggttatttttcaacatacacctcaaaacacacagcgctggcagctcctatgagagcacatgtatttgatatccaaatttttctagcctagtgtcccacaccaatcccacaagcacaaatgtaattcttcaaaaaggagcatgctaagaagtgccctgaagtttgcagaatgaactcatgcagcactttctgagcaggctgggttccccttgcctatgactatgcttaccgaaggtcaggcttccctttgacaagacaggacaggtactgtatgcttagtttctctcctctgtctcaccagtttcggaggcgtgttcaggttctaacgtcaggggtgaggtgaatccaggtgaggaatggtggagtgaaggatgcagtgatgggcctgagctgcaggcagtggtgataccagctcctctccatggctctcaagtcttgaacacacatcaattcctctgtctttcttcatggctgaaacaattgtcaggttaacatattatggtaaatataggtgagaaggtgacacttttaagactatgcctgaggctgttgctcccaggcactctccttattaagcttctatattagtttaatattagtttagtatgctgggtctgccatcacaaagcacacacagtgagtggcttacagcgaaagaaatgcatcatctcccagttttggaggctggaagtctgagatcaaggtatcagcagggttcttccttctgaggactctgagagagaatctgttccattccttgatcgtagcttctggtcgtttgctggtaatctttggcattttgttggcttgtagaaacatcatctgatatctgccttcagggtcacatggcattcttgtatgtccgtttgtgtccaaattccccctttgtataaagataccaggcatattggattagtgctcactctaatgacctcattcagctaatttcatctgcaaggacagtattctcaaataagttcacattctgagatactggtggtaggacatgaacatacaaattttggggaaacagaattcaacccataacaccatagatacttggttcaaaccaactctcctgaatcctgaccttcctgcttgctccataaagtttgacttgattccctcagttttcctcaggatttcagtggcttccaccttttgaaaacaaaagctgattttctgaattataaataccaggcattctgattttagcaaatgtagaggcttttgatacggataaagaaaagataaacgaaatccagaacccaagtcatagatcttgagtcatacactcaagcgcagattcatgtcaaactgtttccttttagtctttcacatatatctatagacttactttaaaaatgaaaattggcattgtttatatataatttctcaccgggcttattttaccagtgttacattgtgattatctcatcaaattattcaatattcttgaaaatatgagttttcttgagctacaaagctatcacaattggtatcctgttactgtattttgctttgtgcctaatttttttgttttattatattatcagtcccttaatatgtcattttcataaccactttttctctaatgactcaaaagcattccttcagtatttgttctaatgattactcttaaattttatatatacttatccaaacttttttataggtgtaaaagccaagaataaaaaagtatctatgggtttcttgggtataaagtgggtaattttatataattttaattttttattctttctagtcagttccttgttccaataacaataatgtgagactttatacatggtgatgatgatgctgacaatgatagaattgattttaggtttcatgaccatatcatatcttttgacataatttatgtttagctgagattaagttatgcaatacattcttgagttcttttgataggctagaagatgtatctgagtaatttttcccagaaattatatgtgagtggtatagctggtgagaccttgaatctgggtgaatctctttctttgccctcatatatgaaagataagatggctgggtatagaagtttgctcagagaggtgcatattctgttccattgaccttggatgatgaaacccagtgttttcatgtataaattacctgttttaccagcctgcacagttagaaaactttctttacccctatatttcaaaattctttgatatatgtttcagaattatttctcttttaaataatatttcggatacttcatgaatttttctatctgaaaacacaggattttatgaactcttgaatacatttaaaaaatattttctgggctgggtgtggtggctcacgcctgtaatcccagcactttgggaggctgaggcaggcggattatgaggtcaggagatggagaccatcctggctaacacagtgaaaccccatctctactaaaactacaaaaaaaaaaaaaaaagctagccgggtatggtggcgggcacctgtagtcccagctactctggaggctgaagcaggagaatggcgtgaacccgggaggcagagtttgcagtgggccgagatcgcaccactgcactccagcctgggtgacaaagcgagactccatctcaaaatagatatatatttttttctttaattatttccttttctgtgtcctgaattcctggaatttttggaaaaaaataggttgaatattcatgtccagttcataggtttttaaattgttctatcaggggttttttttctctaaatttttgtgaaacatttatagtttgtatttgtattttaccccactaattcaattttatgcattattctactgttttcagtccttaattcatttatcatgttttttcatatctatccagtttattcacatcctagcctatcccctcattttagcagattgttctagtttcacatacaaaattcctttttggtttatgttgtgataattaattagatgttttctaaaacactaatttttactgtttgctaaacaatcttacttttgcccttcagtaccggcaatcctgagcaaaagaaggcttgctttgattgccagtaaaacccatgttcttgtggccataatcttcacctcacataacctaaacaccctccttggaatattacaaaattctcccgttcccagctgcagaactatatgaattggatttacagatatcatagtttttttcagcatccacatctttaacttgaatttcaattaaaacttattggttggtcaaaacttaaactcttagaagattttttgctcagataccatgtcaaagtttagaggacgttcactgaatcctttcctctggccagccttactttcctgtcttcccacccagacagttttccagaatctgagcattgaaatctcctgccaaacacaatggataacactgaatctcaatgctttcaatggatggcattgaaatctcctgccgaacacaactgatactctggcttcatgttcatgaaggttctttacacccctctaatcccctatcgtacttcaatggttacttccaaggaagttctccaatctgccttttgttgaggaacttttgcatagaagaaagggcaggtgtatccacgcactaggtctaggtttgaggctgccttaaagttactgagggcaaggggcttcataatttggagcctcaccttccccgtttatacatgaggatcatgatagtggacaggcatttttcttagaaataaatgagataatttgtataaacaactttttttttgtattttgttattgtgatcctttcttcatgtctattatgtcaagtgatgtacttatgtgaaagggattttttaatttttcttgtgattaatattaactaagcacaacgattataatttgctaagttaaactgaattaaattgctttatatatctagaaccagaccggaaatatctgggtggttattatagctaaattccatactatagcaataagataaaatatgagttatttactgtctaatatggacatatacatggctctgtatatctatttttcttcatcaaatatcaaatgcaatattacacattagacacaacaattaacttgtgttcatgtttctgaaattgattctaatgtattttctattgtactcagaaatttaccatcaatttgcaagatctttataatgattatttaaagattaccttatttcttcacctttattgtcttgaaaaatggtttctgctcaaaaagaattaaatctgtaaatgacgagttaatgggtgcagcacaccaacatggcacatgtatacatatgtaacaaacctgcacattgtgcacatgtaccctaaaactttaagtataataataataaaattaaatctgtatgaaatattatatattggcaataaaaaatgaaaataaatgagataaaaatagatgttcacgcaaccttaacaactttacaatgctattaaaggaaaattttaggaaatttcctattcagttgggagttgtcatattggaaatgcaaatatggacgtcagagttacagatatagtcagatgcctcaaccaaatcagaccaatgtcaccttttcagatgacaaaatttgaaggagcattgcacgttccagagtcccttgattttcacctgtaatgatagctagttacatgagatgttcttgaattttgaaattataaagcatttttggggggcatgaaatgttcatgaaagaatgagattttaaattttatttacatttctgtttttatctttctaaaaaaatcctaaattaattctgaaatcatcttgctctataatccaaccactagagagtagtataatacctctcctagacatatcattcatgaaattttattaaagtttttattataggatccttattttcttttagtttaataattctatcaactcaattgaagtttatatcaatccctacaatttttttttgcaaatagctcacttttttccccaaattgctgaaactacaaacctgtcatttttcattttgctcttgctttgtcttgaaatacagtgactattcttgtctccaaactctttgtctgcttattttggcaaaatgacaacatttacacaagagatggcaagaggaatgtccattttctttattagataacttcaacaagcatccattaagcaccaaaaacttaccaggcacagagtgcaaccaagggtatttctacaaataattacgaggcttttccttcctttattgataaaacacgcagacagatgaagacataatctgtgtgtgagcacagtgggtcaagcgatcagtacaaataagggtaacggagttcagaaaggggagaaaccaatgcaggatgggctgtcagaaaaatgccacaaagaaatagaggagtgggcaggagcagagccttgaaggacaggtatgaagcagagcgttaaatcaaatgtgtccaatccagaaaaaggggatcccctcatgtccagccaaggcaggacttttcacatcatgtccaagtgtgcaggtcattttattgaaaaaaatatatttgcacagaaaaactgatgaagtctagattgcaaataacctcttttgcctattttggaagtttgaagtaatcctgtgtgcctgtagttcccaacctttttttctgcctaaaaatagaaaatctgagctataaaacctatgtgtcattaataaaaatggataatgatgacagcgatgcatgacatgatggtgccgtcctgagagttgggggaaggtgtgtatagggattgcggcaggggttgggagagtttagagaggggaagcagtgtataaggatgagaagaccctcgaagagggtcccaccggccccctggggagcctgtgcaaatggtgcctcacagcaattaccttgccagggtgtgagatctcccttagagggatagaggcatttgtgcagttctgcagatcagatttctccagggccagggcaacttccctgtccaggcctaggccagttcttttgtcctttcaggattctagatttctcttccagtattatcacaatgtctcctaagcaactgtgctccttgaaaacatttggtctcactcctcagcatcttgcacagtgaccatccagacctgggtcattcattagtttgtctacctcatattcatttctctttgaaatacatctataactcagtatattagctctgtttgttgtttgaacagtctaacagtggtgccaccaacttttggcacgctctgttaaagagactgtagatgacagtgcccttttatattccgccatgttgcactgctattttgtcctagaaattgagccagttaaattccatctgtcttttctttttttataactatataaaatcatgtatcctacatttaaatataaatacagagctttgttagaaaaaatcaggctcgtttgatgataatctttaatttgatatcaagaaatacattctattgagtacctaacatgtgaaaaacgtccaaatcaaattccaggtctttttttctcaggctttttcttcctttgtttccatggaatcacaccttctttctgtagctttgatcctggaaaatgttgtaggcatatattataaatcctgctatatgtaactttggatatattttattgagggtaagaaaattgtctcttggttacttgtgaatatctatatgctgaataaagctgagatgaataaatagctcttccttcctttgtcccatgtcttgataaattatctttttagcttttagacctgatgacttaccttgtgctttatcagaacactttgttgccttaggcaggttcatgtcggcaggtaatgactcactcgagatattctctgcactttgataataataatctgtgatttttgagacatacctatatagctaactggatcaatgtatttcacactgcaggttgcactcattgttaggatctgaaatacatttaatattgtaaggccaacattaaagaaaaagaaagagaaaaatagggactaagcaatatcaaaatgtacctcatggaaaaagtgtaaattattcattaatattttgcattcccacaagtaatagttgaaaagtttagttgtctcagttcttcacagtacgttttaattttagctattctaggaggtatgcgttggtatctcattgtggttttactttacatttccctgaaaatgatattaaacatttaaaatatgctaattgactgttcatatatctcctttcactaagtatctgttcaaatattttgcacattgtaaatggcaaagaagacttttgttttcttatagtcgagttctaagaactcttatatgtgctagataccggtcccttatcatatatatgttttgtaaatattttctcttaatctgcagttggactttttattttcttaaacgtatttttggaagagcaatggttttcagctgtgatgtaacttgttttataaatattttttcttttatagctcaaattatttttgtcccatataaaacatctttgcttagcctaaggtcacttccgttttcttaaatgttttcttccagaaatattacagtttcagctcttacatttaggtctatgagctacttcaagttaagttctgtatatggtttgaagcaataattgaggtccattttggccatacagatttcttagttttttttcccctatgtatgttcacatattccagcactactttttgaattttttctttctccattgaattacctgtgcacatttgttgaaaaccaattaactctatctgtgtgggtctgttttcagaatctaatcagctccttaggtccctatgtttatctttgtgtgaataatatactgtcttgattaggtaactctataatgagtcttaaaaccaagtagtctaaatcctttcactttgttcttattcaaagttgtttcagtcatcctgtatctttggaatttccttgcagactttataattagtttgtcaatatcctgctgggatgatgattgggattgcattgaatcaagagaaataggagaaattggcaaaaacaaaggggctacaggccccatgtaagtcccaaatccagtagggcagtcaaatcttaaagctccaaaatgatctcctttgactccatgtcttgcatctgggtcatgctgatgcaagaggtgggttcccatggtctgggcagctctgcctctgtggctttgcagggtatagcctccctcctggctccattcatgggctggtgttgagtgtctgcagcttttccagatgcatgatgcaagttgtcagtggatctacctttctggggtctggaggacagtggcccccttcttttggctctactaggtggtgccccagtaggtactctgtgtggggactctgaccccacatttcccttctgcactgccgtagcagaggttctccatgagggccctgcccctgcagcaaacttctgcctgggcatccaggcatttccatacatgttttaaaatctaggtggaggttcccaaatctcaattcttgacttctgtgcactcgcagggtcaacaccatgtggaagctgccaagacttgaggcttgtaccctctgaagccacagcctgagctctatgttggtccctttcagccacagctggagcagctgagatgcagggccccaaggccctaggctgcacacagagaccttgggcttggcccatgaaaccactttttccttcaggtctgtgatgggaggggctacagaggtctctgacatgccctggagacattttccccattgtcttggggattaacatttggctcctagttacttattcaaatttctgcagcaaactggatttttcctcagaatatattttcttttccatcgcatggtgatgttacaaattttcccaaccttaatgctctgttccccttttaaaactgaatgcctttaacagcaccctagtcacatcttgaatgctttgctgcttagaaattccttccaccagataccctaaatcatatctgtcaagttcaaagttccacagatctctagggcaggggcaaaatgccatcagtctctttgttaaaacataacaagagtcacctttgctccagttcccaacaagttcctcatctccatctgagaccacctcagcctgggtttcattgtccatataattatcagcatttttgttaaagccattcaactaggctctagggagttccaaactttcccatattttcctgtcttcttctgagccctccaaactgttcccagcctcttcttgttacccagttgcaaagtcacttccacattttcaggtatcttttcatcagcaccccactggactgtaccaatttacggtattcgtccattttcatgccgctgataaagacatacccaagactgggcaatttacaaaagcaagaggtttaactggacctacagttccacatggctgggggagcctcaaaatcatggcagaggcaaggaagagcaagtcacatcttagatggatggcagcaggcaaagagagaatgaatgccaaatgaaacgggtttccccttatcaaaccatcagatcttgtgagacttattcactaccacaagaacaggaaagcgaaagacccaactccataacccaaacaactcccaccaggtccttcccacaacacatgggaattatgggagctacaagatgagatttgggtggggacacagagccaaaccatattagtgagtattggtagtttgtggttttatgagaaactagtctaaggtgtttaatttgtatgtgtagaattgcccatattattctcttattattctaatatctggaagatcttcagtggcatctcgtatttcattacttatattggtaatgtgtgtcttctctcattttcacttcttcagtctttctgtttatcactttgatatctatttcacatcaatggttttagctattataacttatgttgagtagtgtttatgtgagattttttgtttgccttattttttatatctttttgctttaacctttctatgacttaacttaaagtatgtttcttttacacagcatatgattaggtcttgcattttatacaatctgataatatttgctttttagttgaaatacttgcagtatcaaaattcagtgtgattattgacaatgttgggtttcagtcttgctatttgttttctgcttatcctatctatcctttgttctatctttccccctttcttgccttcttttggattaagtccatatttcattgtattaattgtataaaacattattttgtctccattcgtggcttattctgcccctcttttgttgttattgtttgcttgtttgttttcccctacaattcagtgtgtgtgtgtgtgtgtgtgtgtgtgtgtgtgtgtgtgtgtgtgtgtatataattactgtctatcttcaagtaatattgagtctggtcacatatattgttgaatcttattacagtgtatttccaatactcccctgctagacttgctactatttttgtgtgtattttatttctacatatgatgtaaacttcacaaaatatggttaattatcttttaaatggttaattatcttttaaagatattttaaaactgataataaaaggtgttacatttaaccacatattttctgactctcatgctcctcacttgtttacatcggttgaattttttctgatgttcttttctttctgccagaaaggctcctgtgagcagtttagtgcaggtctgtgggcaatgacttctttctactttggttagttttagcaagactcaactttacttacttttttgaattttttttttttgtactgtatagagaattctatatcaacagtttttctttgaaaactttacaagtgtcaccccattgtctctggtttgcatggcaaaatcttgtctttcttgtcttcatttgttcgtaatttaaccctggcccctttagatatttttttcttcatgactggctttcagcagtttgataatgatgcatctcggtgttgttttcttcatatgtccttggcttaatattaacggtacttattgcatctgtggctttatagtttcatcaactttggaactatttatttcaatactcccttcaaatattttttctgttctatctcttctttcctctgataggagtcctaactctgcctcccctaagtctctaattgcacatattctatactgcttgatattacacttcaagtcattgatgctttgttcatttttatctggttctttttctatccgtatttcattttgtgtagtttctattgttgtttatgagttcacagatgatttcttctgcattgcccaacttcctattaatcccaaccaatgataatttttcatttcagatattaaatttcttatcttctaaagtcttacttgggtttaatttttatattctatttccatttatactatcctttttctgccttcttgaaaatggcacatatttatgatccgtgttttaatttccttgcctgttaattttatcatctgtttcatttctttattttttggactgttaaaatggatttatttttctccatatatataattttgctttatataatatatacatatttctgctttagacatgttttgtaattgtttagtggatgtcagccattttgaattttatgttttgggtgctggattttttagttttctttcaatattgttggacagtttactgggatgcagttgagttacttggcctcaatatgattccatcaagccttgctttaagccttgtttgcacagttcttgtttgcatggttccagtctagaactgattggctcccttactaaggtaatattaatacaattctgtggtttctacttgatttctcaaatattcagacatactttcactgacttgcagggatacaaactattcccacctctgtatgagctccagtgattcttgttcttgccgtagccttggctaatcttcccacatgcattatcagaataactcaataaaagacaggggtgggccctctgtaaaactcaggatctgtccacctctcactaggattcctctagtactttttcctacattctagctctgtggcctcttcagcgttgaaactgtgctctcaactcagagaagagaccatcaggctggttgggtcatctctggaaaagcagagatttcactttgttcgctttccttatttcaggcttccctgcatgttttccaaatttataaatcactatttcatatattttgaccatgactcaagttgcataagataaaagggaaaatagggactttcttaatcaaggctgaatgtggaagtgattatagtgtaatgtaacatttaaaaatacaaattacattctaatggaactttttaatgccatagctctcaatactcagaagctaaaggtattgccagtatttactgtacagtttttatgactatgtatttgggagcagttttgaaaatacacccttaggtatttaaattattctttaggcttaatggttttctttctttgtaagcattaatattgaactataattgttatccaaataaatatttagtgatttctcagagaaaaagataaccacacattacctaaacacctggataggtcagatgataatattctagttccattcataacatactaaaaatggactatttggagattgctacctattagagaataaatgtctcatttatcggaatcacactagcctacgaactctagttatgtcatttaaaattatgactggcatcatggggcacacagtgactgcactgcacatgtgagtgaacacgtcactccagctgtgtgtcagacaggggtactgcatcatccctcctgtaggaatgagtgggctcggggaaggaaaatggagggcacatcaacagacaaaaacaaagcctactgaatatccataaatgatgtaactaaatcttaggatagaagaaacctacaagaaccaatgccaacttacgactgatgaatgtctgttgctgtgtcagaaataaaagatattcaattttcaggttgtcaatgctcctcactaaatgtgttccccaaactgaatgtgatgcccagatgatctcgtagggcaatttccagcaaatgtctcataaccagcatgtcccttcacattgtttgtcaatagcctttcaagcccttaaagctcaacatttccagaatgtatggtttcccattctaatgataatctattttaataagttaccttaaattccagcttttcagtgtcctgtccccccaccctatcacagaccttccaacttagtaaccattctttctttctcatcatccacgtcatcaatgaaaattgtcaatgctaaccctgaattatttaggcttagtgtacttcattctttatttaatatattctttgttttcatgttgggcaccgagatgacccagggcttagataattctgtgcctccttgtagcaacacaaacctattttcaggcaaagatgggtaatatcttctgttgttaaaacacagtgaacacagttctgtagtgctgtgtaaacccaccaggtagccagcgagccttataaagagctaagttcctttgatgggctccttgaaagataaggaaccatcaagatattcctctggatctggttcacacccagaagggttataaccagttattaagagatgcataacaaatcacccagaaagttattactcaagataaacatcattgtacagcttatattaataagtttttgggacaggaagcagagcagggttctggagggcagcttgtccctgcttcacatgctgtcacctggactgggtctgaagaatcaaaagtggcctcccacctgtctagaacctcagctgagacagcccaaatgagtgggcttgcagacctctggagcctcgctactcttccacatgacccttgtctttatatggagtgtctcatcctccagggtctcccctccatgtgacctccctctttatattaggaagtttggattccttcttatgtctgctgggttccacctgagcaaaattagaagcttgaaagacctccaaagggtcaccttgaatctcccaggacattacctgcattgctttctattggtcaaagcaagtcacaaagccatcccagatttaaggggcaggaagagtccctacccttgaatctgggagttaaggcaaagttgtctcacaaatgggttgttgacatggagaggactgatttattggagaccttctctttttaaaatttagttttagtggacacataaaaattgtatatacttatgttgcacaacatgctgttctgaaatatatatacaatgtggaaatgtacacaatttattctaactgagctaaattagataaagctaattaaaatatatattactgcagactcattttttgtggtgtgaacatttaaaacctatgcttataatgattttcaggtatacaatacattgctattaactatagttgctatgttgtacaatatatttcttgaatttattccacctgtttaactgaaagtttatattctttagctcgtatctctccaatccctccacctgtcagccccaggtaaccaccattctactctctgcttttatgagttcaagtttttagattctacctatgaggctgggtgcggtggctcacatatgtaatcccagaattctgggaggtcgaggcaggtggatcactcgaggtcaggagttccagaccagcctggccaacacggtgaaaccctgtctctactaaaatttaacaacaacaagaagaagaacaaaaaacacaaaaattagcatgtatggtggcacacacctatagtctcatctacctgggaggctgaggtgggagaatcacttgaacctgagaggtggaggttgcagtgagccgagattgtgccactgcactccagcctgggtgacatagccagaccctgtctcaaaaacaaacaaacaaacaaaaacgttttacatatgagtgagatcatgtggtatttgtctttccgtgcctggcttgtttcacttagcgtaatgtccttcaggtttatccatgttgtttcaaatggcacgatttcattgcttttttaaggctgagttgtatttcatggtttatacatattttctttattcattaatgctttggtggacacaggttgattctgtatcttggctattgtgaataatgctgcagtgaatatgggagtgtagctgtctcttcaaatattgatatcatttcctttggataaataccaactagtgggactgctggatcatatggtagttctatttttagttttttgaggagcttccataccattttccatagtgactgtcctagcttatgttctccaccaacagttcataggggttcccttttctctacattctcaccaactcttgttttctttcatcttattgaaaatagtcattataacaggtatgaggtgatacgttattgcggttttaaattgcacttccctgatgatcagcaatgttgagcattttatcatataccccttggccatttatatatcatctttctttgttgttgttgagacagagtctcactctgttgcacaggctggagtgcagtggtgcaatctcggctcgctgcaactgctccctcccaggatcaagcgattctcatgccttgccctcttgagtaactgggattacaggtgcacgccaccacacccagctaaattttgtatttttagtagagacggggtttcgctgtgttagccaggctggtcttgaactcctgacctcaagtgatccacctgccttggcctttcaaaatgctgggattacaggcatgagccactgtgcccggctatatatcatcttttataaaacaagtattcaagtccagtccccattttttaattagattatttgctttcttgttattgtattgagtctcttatgtattttggatattatcagatatatgatttgcaaatatttcctttcattttgtaggttgtctcttcatgctgttggttatttcctttgctgtgcagaagctttttagtttgatatcatccatttcactatgttccctttattgcctgtgcttttcgggtcaaatacacaaaaattatttgcccagaccaatgccatgtggcttttctactggggaccacttttagcatatatcactaatgcttacccccaaaattgcaccagtggatataatgctaggtcttgataaattgctcaactcctaagtgcatgcatagatattatatacacaaggtctcagagggataatatggtaagatggctgctctgatcccagtttaatgcatgaaagaccctgttacattttcccagggtctacctctgctcagtgctttcagaacataagcatcactcagtatgaaaattattatttttactagacaatatacgccactagattctcagttcctgggggccatgggctatgtcccattcacctttgcatctcccatacttcatggcttctgttatacgggagccagctgcccagttgaaaaaccaaaatagctcaacttgaataatacatattttgtactgaagcaaattaaaagccttgctgtaaccacactaaattatttcatatgtctctgagatcctagaatctattgcctaggtctgttactgggtgtgcctgctgacctcatgaatatcagtcattttaggaaagatgatccatccattgaatcaaaatggaaatgaatttgaagcaaacagtgccaggagtgcaaactgaggagactttcctagaggatgacagcacagtgagctccagtcaaggagggaccacgccttcctccactcactattctatatccaacccctggcctggagcctggtgtatgacaagccctatgtgttaaatggagtgttggcaatgatagaactttccggagaggatatctaaaagtggaattattccctgtgtttatttaagtgcaattcaaagagcaggtttttcagagacacacaggaggagcctggaaaatctgtgacgtgttaagggacttgtgctgtattaaagaaacaccaggtttccaaggaaacccttttagccttgtgcttaatgtttgctcttctgccctcaagaggcccagtgaacacacaattgtttataactagtcaagagactggatcttaggaaatcacttgcaaaattgtccaaaattcctctaaaatctttgatctaagagatctccaaccgcctcttggttcacagaatctgaaacagtatcttaactgtttcactttgctatttatgtacatttccagaacattttgcaaatgtaaagtgcctcgtagcagcattttgtttgtaccatagatgaatccctttgaagttaacctttattgaggcaattgttaaatgcagtatcatgaacttgtgttcacagaagacaggaaaagtgtaagctataggtctgaaataagagagaaataagagagtcagcaagggacacagcagtccatctcagggctttctcatttatgttaaaaagggaattaacatagataatctatgtcagtttcttggcacaatgctgaacaggtagttcagtaagttgtagccatgatggtgatcatgatgatgatgaatgatttggaaacagacatgcctgattttcatattattttctaagatattttcttcatcaaatgttctgaacacttaaaacttaactgctgtatgcttgtcacaggcacattcaatactcaagctttattaatgagcataatgtcctcatcagccattcaagtctagggccttctatcacattttaggctcaactatcttcttttgtgattttgtcattggtagcctcatggtgaaatttatggctctacagagagaagggcatgtgtattgtgtgtgtgtgtgtgtgtgtgtgtgtgtgtgtgcacatgcatgcttgcatacatgtatgtaagcatgtgtgttgatgacaatgattagcctgccaaaccacccatgtaagaaatcggctgtataaggcatagtttgttaaaccacaagtctgattttaaggtttccaaagaaaattccactgggcattgtctttaatttattctttgtaaaatagatttactctgtagtcccagctacatgggatactgaggtgggaggatcacttgagcccaggaggcagaggttgcaatgagctgagattgcatcactgcactccagcctgggtgacagagtgagaccttgtctcaaaaaaaaaaaaaaagatttactaatcacctggacattaaaaaattgttcttttaaaatgtacattctccattaaagtatgctagttcattgataccttttcctttttaatatttcaagggatcactggaaatatatagtgatgcttttaataattatgtcctttctaatcattccacatcattgagcgtgttaagcacacatgatgtcagctttggtgcttgatagaaatgatacaaggttggcatgttattggaagtgcctgctttcagtgtctagtgaaggatattgggaaatagttaaatgagccagaatagggaattactatgaattatggggtgggggggtataatcttgcttccaaattttctcaattgtgttaattcattttttcctgtacttgtctctcttaagtaatacaaagaaataatttattgatagctattgccttactctgagttttgatatgtcattaaaattaagccttaaaactttgtattttgaaaggtcaaaaaatggttagtataatgagaacctgacttcctaaacctaaaattaaaatgtatctcagaatcaattgaatttttccttcaagaaattgttgttaaatcttcctctcaataaattaaaaaaaaaaaaacaaataaaaaagacaatgtcaattttgagttaagtgccattttttttaatcctgtttatctacaaggagccacagtctgcctaactttaggtaaagaaaagcagtatcacttggaaatatatagatagtttactccccgtggaaaaaatcattatttctccatttagaaataatttcacatttaagatctctagaactttactttttccctaggcagatacttgttctaatgatctgagaggtaaaaactcttagcttagcttcttcttaggaatctaataccatttgtcttaaaaataatatattttagccgggcgtggtggctcgagcctgtaatcccaccactttgggaggctgagacgggcagatcacgaggtcaggagactgagaccatcctggctaacacagtgaaaccccgtctctactaaaaatacaaaaaaaaattagccgggcgtggtggcgggcgcctgtagtctgtagtcccagctactcgggaggctgaggcaggagaatgacgtgaacccaggaggcggagcttgcagtgagccgaggtggcaccactgtactccagcccgggcgacagagcgagactctgtctcaaaaaaaaaaaaaaaaaaaaaaaaaaaaggaataagaataataagaataaattttacttgaccatttagaaatcataaatgttccctgtcaaccacacggggaacttaaaagggggaaacatttgattattgtccagtgttgctctgctcagttgggtgtaaaatatagctagcaaggctgggccgacttctggagaaagaggaaggagagctggcaagacgggcccatggcaggtctccaggtcagcagcctccagaggggaacatggggcccctttggaaggccctggcttgggctgggctttgtgctgttctcttgaccctggtgggaacatggctgtaagaataccatccctgtctactctccttatatcctttgtaacatatgattatcccatctgcagcacattttaaatcacaatgccaaagtgcaacagtcctcaaggagtggtccctgcacgcttgatggtctccaagaccctttagggatttgcaaggtcaaaactactttcaagataatattgagatatcattcactttctttgttgttttgacatctgcaatggtggataaaattgctggtgtctcagcaggtgtcaaggctgcgggatccaattatacttgttttgtgtaaatagtgtactatattcttcactgctacacactaacagaaaaaaaaatccaattttattgagaatatcctttatgcagccatataattattagttttattttatctcaacccttgagtatatgactttttaatagcctctgtgaggaaacaggaaatgtattcccataaagtgtggttattttgaggaaaagcatttgagtggttgagctgcaagctgaaataatccttttcttaatagaactttaaaaaagttacttttcctgttactgttacttttacttagcggaacaagggacagaaaactatggtaatttggactacagatgacagttattttctcaaagtatgaaccaaggtgatcctgttacttcaaggaaaataaccaacagtatttgattcaatggtaaaatttttcaaacaaaaattcaaattgtggaaaaactgtatccaccattatgtacttgacagcctcccaatatttaaagaacttttgtgatgagatcagtgattatattaacaaatatgattttttagtgttatatattgaaacctgtcaacatttgaaagatctgcataactcagtgaactataaatgactaatgcatgatgttacaaaagtcatgcattagtaatagatccatttaaagctcaagatagggcaatcaattttaacataacagagtatgaaaataccattccaactaacctttaagaaattaccccagaaggccaggcacagcggctcatgcctgtaatcccaaagctttgggaggccaaggcagaaggattgcttgaggctaggagttcaaaaccagcctaagcaacatagcaagaccttgtctctacaacaaaagtttttaaattagctgggtgctcatgccactgccttccagcctaggcaagaaacccagaccctgtctaaaaagaaagaaagaaaaaaaacttacctcagtagaatattcacaattacttacaaagactattaaaacactcctttattttccatctacatatctctgtaaagcctgaatgcagatgcagatatgagaattgagcattctattagggtagacgttaaaaagatttatgaaaatataaacaatattactcttctagctatttttttgttttggaaaatacaatgttttcattaaaatatttttaaataatgtaatggggttactatttcatttttaaaataaatacatattttaaaatcttttaagatttctaccacactaaatataaatagctacaaatcacataatgaaacctctttatggtctccaataatttggaaaagtgtaaaggggccctgagacctgctgcacgggaggaaggtgctcccggaacagggagaaaggttgagtctggggaatgctgaccatgacacctgcttcaaacacagattccctgtggctgtttttcctctaggattctgttaaaaatcctgttgaagaatccattccacatatgggtaaaatttagaaatatgttccctggaactgggaaatccagggacaggagaaaaaagcagcaacattgctttgttactttgttttacttgctacatcagacaaaaaacaaaaaggaatggatataattattttacgtacctcttaagggcagtgtgaggtttatgtgagtcaacgtttataatgcacttaaggcatacttgtcactactaagtttatataaattcttgttaaataaaaatgaatgaatgaatgaataagcagcttctaacagaaaccgtggcagcattttttgctgagcacattgctaggcagtaactaaattaatatgatgcttgacctcagagatttaggaagttggtccaatctaggcacatgcagagaagatacgtttagaattctgaattttgatggatattatctcaaatatctttctgaaacacagcgaaatataaagacttttataaaatcagatagcatgcacacaggaattgacaatccaggctctccagtttaagtaggtggatttcctaaagaactctaaagatatttaggaactagaagtgactcagcttccaatatagaaacccttttccacccatactctcaaaatcaatgtgaaatagctatttgtagatggaatctttggactcctatgttttgttttgttttgttttgttttgttttgttttgttttgtgagacagggtcttcctctgtcacccaggctgaagtgcagtggcacagtcatagctctctgcagccttgacctcccagtttcaagcagtcttcctgcctcagcctcccaagtagctgagaccacaggcatgtgccatcacacccagctaagttttctatttttgtagagtcaaggtctggctatgttgctcaggctggtctcaaacttgtaggctcaagctacttgcctgccttagcctactaaaatgctgggattacatgtgtaagtgactgcacctggtctggaccccaatttggctgaatcattcattcctcaagcaacaagtacttacatgggagatacaaagaaaacaatattgcctcttcttagaaagaaactcctaggctgggtgcggtggctgacacctgtaatcccagcattttgggaggcagaggtgggcagatcccgtccctactaaaaatacaaaaattagctgggtgtggtggcacacacctgtagtcccagctacttgggaggttgaggcagtagaatcgcttgaacccaggaggtggaggttgcagtgaactgagatcatgccactgcactccagcctggcggcagagtgagactccatctcaaaaaaaaaaaaaaaagaaagaaaaaagaaaggaaagaaacttctaatttcacagtggagatttcagtgtgtatgcataattccaaagttagcggagcagacagagcaagggtgttgggactgtagagccctagaggctaattttaagtccagctccaatcattttgtatctgtgtgacagcaagcaagttatttattattttaaacatgggatagggaattgggggtattttgacattttaggaagaggaaatgaatggtgtgagtgagcacaggggagaaaactgcaaggtctgttgggaaccatttggagtcaactgcaaaagggatccgggctgtaggttaggatctgggacaaggtcatgtttaaggggaccttgaacttcaggatgctcagaataactgaggaaccattaacattgggtcacttcttaaaatgtctgaatcaaagtgacatgtcccctaagagtgtataagtgcccagagcatgaagattccgtagtttgtagacaggcccaggaccagggaatttaggtaagttttttcagcaatagccagcagaatccaaacatccttaatgaggtactgtgtgcagcacagcctcctaaactacaagcttactctcaaaagtgtaagttgacaaggagtaatgctccgggtgctcttagagtagtggtagaactagtggcagtagtggtggtggtggtaattgttgcagtagtaatggtggtggtaataatggtatagcaataatagtaaaagtagtggcagtagaagtactggtagtggtagtagtggtggtggtagtattagtggtagtagtgatgatagtaggggtggtagcagtattggtaatagtagtagcatagtagtggtggtagtattagtgatagtagcagtagtggtaatagtggtagtagtagtaccgccaatagtaatagtggtagcagcagtggtaacagtagtattggtagtgttgccaaaacactaggggttcagtctaggtcctactgctcgccacatgaatgccaatcactgagtgttttaggctgttcttgaattgctataaagaaatacctgagactgggtaatttagaaagaaaagaggtttaattggctcacagttctgtaggctgtacgggaagcatggcattgggcatctgctcagcttctgggaggcctcaggaagcttctcatcatggtggaaggcaaagggggaacaggcatgtcacacggtgaaagcaggagcaagggagagagtgagagggagttgccacacacttttaaatgacaagatctcgtgtgaactcagagcaagagcacactcgtcaccaaggagatggccgaagcccttcatgagggagtgaccctcatgatccaatcacctcccaccaggccccacctccaacacgggatcacatctcaacatgagatttggcagggacacagattcaaactatatcactgagacaatgattattgccagtgaagaagactattctggtgctgcagccaaggagatagaagatcagtctcaaatccatctctcagattgattaaaattggggtttttataggatgaaagcaatgtaaccatgtgtgggaaaacaggaattagggaagggtaaggaaaaggagtttgtcaataggaagcaggtggtcagttaggcaatcatgataggtgagggtctggtacctcactgtctagatgtggtgatctgggaagtttcagttctttgatgttatctgggaggccctcatggttagtttcctaagaaaaggacttagataagacaaatgtaattttgtcaagttgtaagactgggagggtcaatttctatgtttattcaaaagaaactataaacattaattctataggacagttgggccagcatcagttgtagtagctgtggtagatggtggtagtggtagtagttgtggtaggagtggtggtagtagtagtagtagtagtagcagcagtggcagtagtaggggtaataacggtagtagtagtggtagcagtgttttaggggcctgcattctccagtattttcctcacagaccagtggccacaaccatttccagttaagtgttccgttcctggtgggcacccagctcaggaacactgcacgtgtgtactgtgagttgccccccatctgaaatattcttcacctgctcaccctccattactgagctgaaacttccacaacaaaccaacagcctccttgtgttgggaaaccgttcccattacagtagatattaacgagccctaaatccaatctaactgaatttggctaattcctaaagttaggattttctcagaagttggcgtgatggtgaagaatcccttttctctggtacccgttatggttgacaatcagtgaagttttcttgtgcaattgcatggcatttaaacattattttagcatatttttgtgaactaaatatactattttggaatttgaatttatcttttggtgagacatagtagcaaggaagaggaagtaaacaaaatctctctagtgaattaaaatataaaatggtaaatgtcatctcgatttaggaaccctgtcggcggttcagaagcaaaatgagctgccctgagttggagcctccatgggacccgcttccgtaggcacaggcataaagtcagctttctgttgctgaaggcttggaagaggctgcaggagaacactgtaatcagatttgacattccgaactgatggctgatgggctgtgagggccgtggcagggagtgatttcaggggctttaataaggcttggcaaataaatgatcaggtcacactgtcactgtgtgaatgccaatgtctttctccccaatccattccctgagaggactccagggccaaatagaaaataaatttaaaatgaactgtgaacactaaaaaatctttaatagactttgtccatggaaagtgattcttttttataaaattgctttaatgcccattttctttgtgttcatgaatataaagagaaaacaaaaccaatagcaaggtctcagtatttctgatttttttttaagttttgtgatttaagaaaaaaaaagaaatcaaagatacattccttgcgaaggcaactatggaatctacacccaaatctccaaattatattcataagtcaattgtaactaattttagtattcctaaaagaatgaatttacaaattgctctcaacccttttagcctaaaatataggaaaatgttacagtctccaggtaggaaaaaaaacatgcgtcattttacagctggataccaaagagactcaaatttttgatctaaaagaaaaaaaaaaatacagaaggaaagtaaaaatagacctgacctttgaaggcagaaatttcttgtctttaaatttgactttcattttctttcattaaaataaaaataaaataaaataaagaatgccccctaatagtctcttctcaagttaaaaatactgcaccacatcaaattatttttggaaccagccaagagaggaaagggaggaagaagttaaaatacaatgctatcatttcttattgaagttagaattttcataacaatcttgccaatgtttttcgtcaattacactgactgaacacagtatatttgtatcaaacgacattgtttgaccactcaaattaaccatgtaaaaattacctaattctacctttacttccttataaattttccttagagttcccttgggaaatatttaacatacagtaaagatcctgggattaaagttttaaacccctctgccatctaagactgtctgtatttctatcctaatctctcttagtactccccaattacacacaaaggatccaagtctgaactggtatgccttcggttctacagttctcagtgttgaaaatctccctctcccctgtcttccaggtgatattcatccattatccaaaacctcagcccaagatcaaggctccctctagggaaaagatagcttggccctgctaggaagaattttctcactcttctgtaaatacttctgtgcagggtttgtgtggctcaatattgcatttccacttctttctggtttacctgccttggttgaagactcagggaagcaaaaagctgcattcccagacatagctgccagggctctggaagcggttaaaacgcagtcagatgcattgtgtatgtatggagacttgagagactctgacagcctgttgagtgcaggttcatattctattatttttcatcctgactgtataaaagccatctggtctgatgtggaagaaagaatgtggcattgggagtcaggcaagcctagattgtatgaccttggtcctcaacctatgcaatcttgctgaaactcagacctctcattcaactaataaaaagggttaggggaattaaatgaagtaatatgaaaaatgcctggactgtagtaagcaataaagatcattgttcttatctttatctcgcctcatcttcatattctaggtgaagtagataagtgtgaattcactgctgtatttagacccccacaagattgtcattgcattaaaccacccaacaactgccttgactattccatgaatttatcagtttgatgtctttctttaagaaaaagtatagatttgaccacagaaactttccttgagagaactgtattaaagaaataattagaaatgcagaaaaatatctatttggaaacttattttaattataatggtgaaatattagaaacactcaagaacagataggctaatccaattattatatacccatccaatggattattacacagtattaaaatgatgtattaaagcattcaaatgacaggtagccactcataatttagcaacattcatacaatattcattgagcacatgaatctcataaaaggatcaaataaaataagctgaatggaaagctatttaaataacagtttaatctcaattatctaaatactatatatatgtagaaaaaagcatagacggatatatgcaaacatgttaataatggtcagctctggtgttcagctgttcatccttggtaatggaattatgtgggatttatattttattctttctagtttttatttttcagatttttcacactgtgcctatacttgtagtcagaaaaaaatgtaagttaaagttttataaaatgataatatggatttcctattaccttgattttaaaaaaatatgcctataaaaacatatacatttagtaaagtggctttctagaattttcgttgtattttctcctccaaagcacaagctcacaaaagggctgggaacatgtcttttcatgtttaaatcttaatgaagactcatccatgtattccctgttcgtggagctgttatggattgagtgctgctccgcatcagaggtcatgcacgtggatctggagattcctggatgatgaaggggaaggtgccagagcctttgggtatggctttgaagtgggagagactgagaaatcattacctttctttggcagtatacctttaagtctgcactctttagatttgagggcattctaaatctttcatccaagaagactttgtggtctcaatttggagccgatattagggaaccagcctttggagctgcgtgcattaaatatgggcttacacttgatgtcaaggaagcaaaatttgcctgatatctaacatgcactaataattctgtacatgtgtatcagctcattgatctttttagtacttgatttgggggttgaattgtaaattttattatatcttttgaatgtgttaaaatttttttcatgattaacagttgaccttgtggcttcctaaggagctctggccaagctgtgtcatgctttgaaaaatttcactgagttgtggacattgcttctgaggttatattcactgtactactgctctttggtcctttatgggaagcatctcttcaatagcatcttgcagagcttggcaggacctgggggaaatgctcgtgtttgggagtagacccagaggcttcaccgttctgtacgtggtggcttctttcccttctgcgtctgagatacataacacattccccatcctggaattccaattccagtgttacaagaacttgtgttctacccttctttctgacctcgaaggatacttacaataaattcatgtgattattactttctacgtcgtgttggttagtttcttaggaaatcgttgaaaatatatgctttacaggagtaccattttctaatccactctcatcctataactatttaaaaaatacatatcattttaggaagagtgtggcctatagatgaacctctgatctgactatttgaggcttgttttattgctcttagatttttccaaatatttatcaaacactgtttatctttaacccacactagaataatacatgattattattcttaatacctgtacataaatatcacttataggcattaatttttatagtactaataggtttgcatgttcaggaagtactgaggattaaaataaaggaattcctctcatttacccaatatttgaatatgagatttaagatgtgtgttggatgccagacgaggatatgtagaataaccatggagataatgaaggaaataagaaatgacttttgaaaagactggtcaaggcaactaccttatgaagactcagcctcaggtgggtatttcaccggcgtggttcccacagcccgaactccatgctctttttcacatctgcttcccccttggagaggtgctttctctctgggaagaaagaaggggctagccaaacttcctggcgtgtgagatgacccagagtcacattctaatgcctagtctgtgcaaattgtgtcaacataccatactcaaaatgagatttttgtagttagcaatcttctaatttttgcaacgagaaatttccgataacagcaatgtggtaatacacttctctaaatatttgcagtgagcaagtatgtattgagtgaacatacctgatgctatgtgggacactgtaggagaaatcatcatgcaccagtggggagacatcctgtcactgacactgctcaagcttacgctaacctgtagaaaaactccacagtatgaacaaccctggagagaaggataaatcatagtatgaaactgataaaattttaaaaagtccccttccaaagaaagaaacattgaaatgctctatggttgtattaaattactttcaagcacattgtatcatttgatcaaactaagttgatggttctctaatcttctcaatctgcattctttgcacgtaatttacattaactatagcactcttatttcaaacagcaggtgggtagactgtgtaaaatttagcctccctccagatttctatatgtttgtgtttatgcactcagcgatttttaagcgtaaaattggcttcttatttaaagccaaagtgagtgaatagaatactcattgctgctcattctaacagccatgagtccagcccctggtaaggcaatagctctcacctgtctttgtgaatattatttatattgcagcatttgctggtatggttggaccttcagggattgtttaaggagcacaatgatttcatgcggtctgcatcatccaatatgaaatgttatataccttgaaatatttttccatagtgagaaggtctccctccactccctacacttgcaaagaaccatagatacagttttctttcttttattttaagcttgttgctacctgaggtaggcaaggaatgagctgctttgagatgttataatagattcaattgtgtcccctcaaatgatattgaagctctaatgcgccagtggctcagaatgtgaccttatttggaaatagggtcattgaagatataagtagttaagatgaagttgtattggagtaggatgggcccttaatccaacatgactggtgtttttgtaagaagagggaaaacttaaacacagagagaacatggccatgtgaagatagaggtggagattggaattacgctgccataatccagggtcattgaggcctaccagaagctgggagagagaagggaagatcttcccttgaggcattggagtaggtacggacctgccaataatactgctggcctccagaaatggaaaagaataccctgctatcatttaaaccacccggtttgcagtactttgttgcagcagccctgggaaaataatgtggatgccacatcagaaggtgaagccaagagcacagcacggaatagggtgcatcagcaatcagctaacccaaggctatccaccttctctccatgaattattcaggtcttatttttgtacctgtcagtttttaaagggagattgtcatctcttgattggctattacggatccatctaaaatggttgctgtctaacagctgactgatagactccacactttttacccctgtgcagtgaagaagagtcaaaagaacaaaaatgtagtttttgattgaatactaagatcagactcatccacctgctgagcaggtctgaataccactgcacatgcaactgggcaagcatagtcaaaggaggcttgattaagcaaaacgaagctgagacagctccagcctctcccttgccccaccctgtccatgcgtgcagctccccctccaggagatttgaaagggacagggtggggtggtgggggaatggatagacacaggatgagcaggtgaccaaggaggcttattctcaatgatgcctgatgagaagaaacacccagacttgtagctctgaccacacaatacgtcctcttaggatacattctttctcatttattccccgtgtcctcacgtccacacctgttctctcacttttgcatccttcccaaatctgtgttcttaagttttctcttccttgatgcatgaacacgtggcatggccattgggtaggaagcaatgcaggcaaacaagtcggccagtgtacatgaagatttctcgagagtacttgtccattctgcgatggtaacaggctatatcttctttcaaagacaagagtttagggtgtggtttatcactcttttcattaacctgagtcagataaatccagattctgatgtactttatgttttagatggtaagctctttgtcaacttggttcatatggttaaaatgatttggagaatttaacaaataatttaatcaatatacctggacagtattaatgataaaaatcctattatggtaattcagcatagattttctataatctattgtggtactggccaaatacagtggatatctttggaatgtgccagaaagaagtggtgcccactaatcagatgtcttttttagaacattagctgttttttaacggtcctcttttttgttatttctcttcataaaatattggctatttaaaagaatattctctaattaaaatttaatgtcaggaaatgaaagaaagatggtttcaatgctagacatttataatgacttttgatttccttgctcaaatgacaagtgaagttttctcagcatgacatgagaataatttatcagaagatataaaaatgagcaaaatgtacattggagaaaacccttttgtactctcaagaagagagcaaattatcttaaaacacgggggatttctattcatcttttatgcaggaatatcctacttttattaaatacatgttgaattacattgagggaaagagtaaacttaccatattgtatcccacccatttctaaatggcacagggtagttacactgtacactacatttactgtaagaattgctaagaaaagccaacatgaaatgagcatgttctacctggaatttataaacaattactaagtgggaaaatgtggggagaaaatacagggaatgaaattaaaaagcaagatttgcttacccagagtggtgaatttataccaccctactccaatagggtatgtgcatttgaatggattgtaataggttttagtaggattgaacacactttccagaatgtgaagtttgcagtgcttagagttgtatcaaatattttcaaagaacacagctggtttatcagtggaggagggggggtttaaaatggccttaactcccgtgattttcctatgaagattaaatagagtaatgaccatgacagccttatggaaactgtaaagagcaaggtctggtttctcaaacagtaaagagatgcctgccaggttaagatgtgggtgaaatggaatttgtggaaaagtgtcaaaagcactaaagagattgcttttcttcacccacaaatacagcacgctgacctacctcataccgagaaacacaggacttcatgataccatctgctgtgatctccctcccatctgaaatgcaattgtcttccagtgttctagaggcatctaactttttatatcaatcatatttgccattattatcactttatacagtcattatttgtttagggttactcacgcatacctcgttctttctccacccttctttttgcatctcattattgagtacaatttcttttctggaagcacatcctttagttccaggcgcaagcctgctattggcaaactgtcggttcttatcaatactgggaaatttccaaattgttttcccaaatattgcttttctgccatttttttctaccctctccttgaactgtggatttcctctatctctccttcaagtctcttaacctttctttcatatgtatctttctttcttccatatgtttctttttctctctaggaaatattctgagtaatttctgtagatttattttcttgttcactaatttttcccaactgtgtctaatataaatatttatgtcaagggttatgtgttttatttctgcccattctgcaaatattttattgtttatctaatatttgtatcttttatgatatactcttattcacttatcctatttttaattcaattctatagttttgcaacatttaaaatacttattgtgtaaacattgtcgagttatttcattgtctgaggcctctattgcttcttctgactcctttttatgataaattgttctctaatgtgttagaggtttggtactggaagctcaagattggaagggaggagtcaagcttcatctgtaaacatttctcagtgctccttcctccagggaagatttatttgtctttgcttctgccagatgtccttagaagcgaagtcactatatgttattttctagagtgaggtctactggaccctggagacagtgagactacaaatcccaaaccagagcaaggccagtactatggttagacataatccctacacaaagcttaggctaggaaggcaagggtatttgcaaaggctgtttttttttttttggaggtccaatcttttagtgaagttgtacttttctgcagacttctcttgtgtaggacttgtgtaggactaacagccttccatttcctcattgctgttaaaactatgttttttccccctaaatgtgcaaatgtcacagggaaattataggtagtatcaacaagatctttgctgttaggtattcaccccccctcttcctttatagagcccagagggctttccttacctgagaaacctgctgttcatttaagtcaatgttagatttatgcagcttgtctaagtttcttatacctggagagttttcaaaataattagttttttacatagtcagaaatggaagttgctacaactcactgctgattcactgactatattaaactacctgaaaaaaaaatggaaaaataaggttccaaataatgtaatctgacatacatttcatgagagaaatgaccaaaacttaatcctagagggaattttatcttaaaatcctagagggaattttatctaaagaaaattcattagatggttgtaaagcaaaaatgaaattaaaaaataatataaataaacgtggagttcaagaaaaacgtcactgtttccacttttaagtggagaagtaatttgacaaattttcattgaaagaattttgctgatcacgagtttctatcaaaacccaagaagtgtaaacataggaagtgcttataggttaataaagcaaaaatcatgtgttattaacgaggaagtgttaaggtggtgccagatccacgggcactcactatttcatttctgggagcgtttttcagcctgcagttcccacaccacgcgtgccgtggagctctctgtgccacgctgcggggcctcggtctgaccagcagggggcaccgagtgttctcccgcagcggcccggcgtgggcggcggctccaaggccgattcctcagcaccaggcaggtgcctttgaagcaaagggcgttcattcacattcacaaaggtctccggaacagccttgtaggttcttcaactgccctcaactaaagcttcggaatctgaaaacctgggaagaagcttagtgtcctgacagtattttccttttaattttgcaaagtttacaaaatccattaagaattgctttgcaatgaaaaatatacacatttttatactttttgttttcaagtgcttcattccatttatatttagcggtgaggcgggcctaggcaaaaatgaaataaaagcacagtgttaagatctgcaaggccattaaattgcagtgcacgtaattaatggaccatgatattgcttaaacacaaatgtacactaatcttgatccagcggtactagtgatttgttgttacagggctagatccacctaaagctcatggtgaacacttacaaccttgcacagaaagtgactgtgcttgaaagcacgaaggcaaaatcccattggccaaagataccttgtattcctagctgtgaatcggtttatcctctttattttatactttgcattattttattacttggaagaattcacccacttttttctgacaaaggcttatcagatttttcttcttaaaaaaatatatataaagttttgaagaaaagacaaagcattgcaaagagctgtcagagggggacgagaagcttacaaagtgagcaggtggcacacagcctgtctgcagtggtcatgtgagagccaaacccctcagccacattaacagcctacagcatgtgccaagcccttaagaagtcacatagcatttcagagaatcccacaaaaccaaaaacacaaattctgtcaatgcaatacatatatttctaggtagacgtattagtacgtctcttatgtgggtgccgaggaatcttgtaaaagtttgtgcaaaattgacgtcagttttactgcttgtcagcagtgaaatgagtggattcattgattcattcatttgacaaacatttaatgaaccactactctgtatgtgttctagggactgggaatacagcattgaacaaaatacagaactaaatgcatgcttgatggagcttttattgccatggttagcatgagttacattcataaaatatactttattttcattaaaaagaatgagctagatttctttatatcaacatagagagatcttaaggaaacataacgttggatgggaaaagtgagtttttccatgagaaatagtaaaatacttatgtaagtttgaaaaacaaagagaaaatacagaaccatactatgtgaagttcattgtcacagctatgtgtgggagtgtgtgtgtaataaaataaaaagtcgaaactgggaatacacactaatatttctgataatagggttttttaggagaaaaatataggatggggagggaacaaagagaaaaataaagcattttctgtaaagttttatttatttcattaaaaataaataaagcaaattacaccaaatgttaacaatgatcaattttaagaaatgggtacatggatgagtatgtcatgcctatgtgggtgattggtactttttcagttaaataaataaatggcagttggaggagggacagagaaggacatggggagtgagaccaaacaaggatcatgatgagaccagaacttccctagaggagtggcccgttgtgagcctgagagatcccctgtagcgacactgagcagagctccctgtgcctctttccgtcctggcctcacgctgtctggttggctttcccgatccgtcgtccatctctgttgtcctgttgttgttgttgtggttttgagatggggtttcgctcttgttgcccaggctggagagcaatggtgcgatctcagctcaccgcaacctccacctcccaaattcaagcaattctcctgcctcagcctcccgagtagctgggattacaggcatgggccaccatgcctggctaactttgtatttttagtagagatggggtttcaccatgttggtcaggctagtctctaactcctgacctctgatgatccacccacctaggcctcccaaagtgctgggattacagctgtgagccaccacgccaggccttctgctgtccagttttagtaacagctttagcaactgccttgctctgctctcagcattctctgttttaaccatcccgatttcacctctgcctcccttatgtctaccttttgtctcacagtctgacaatgaaaatcatctgccactatcctagcaccaacctgtgggcctccctgaactcccacttacctgggccacgtcagccctgcagcccacggagctcctccagggggtgcctctcctgtgtttccttggctgtgatctccaagcagagggcaggccaactgcgtgtttcctagtccccctaagtagcttcatctttccctcctagcagtagacccctatccctttctctaagaaacactgtataacccacctcttccaggaagcatcgtgaacacagtacttctcaaatctttgtcattcatgaactatctttatgatatctgcaatcattgaatgccatctgtgctagtgtttttgtcctttgaataattcttgtttacttaaaacaatgtaattataaaaaaatgcattactacttttaaatggaaaatcagtttaactagccatacagataaatgcaatacaatgaaagaaaaacaataatattaaattctagtcagatacaattgccttccaaagactctaaaccagcggtttacttttcctttgtctaaaaaaaaagaaaagaaagaaaaaggagactaagaagtgttagagcaatagtgaagataacttacttctgcaaaaacgtgctgagaattctagtggaggcacctaagtcagtgagtggataactggtaccttctgtggctttccctttgaaagaatcacaagaattgagatttacagaggagaaaaagtctcaccatgtgtccggatatcatttctctatagcgtcttatcagctgcataccatcagtgggttccactccattttaattcatcatggatatatcattttcttttcttttcttttctttttttctttttttagagggagtcttgctgtgtcacccaggctggagtgcagtagtggcatgatctcagctcactgcagcctctgcctcccgggttccagcatttctcctgcctcagcctcctgggtagctgggattccaggcgcacaccaccacgcccggctaatttttgtatttttagtagagacgggttttgccacgttggccaggctggtgtcgaattcctggccttaggtgatctgcctgcctcagcctcccaaagtgctgggattacaggcatgagtgacctgcccagccagatatatcatttccaatctctctttacatcagcgcttacgtatatccaactgacactgtttgcctctgttttgcaattgtttgcacttttactttatggtatgtttcctttccttctcattaggaattagccttttaggtaacttggattccattactaggtctgcatatgatgggcagttgctacatgattttattaataccattttgttacaaaggttattgcaaggcaatggagtttgtgataagctagatctggggaagtcatttagggaattgagttactctcacagtgcaaggctctgtgacatgaaagacagtctcaaagattctcatggggtcagactatttgaaaccaaaaggcagtggagtgggagtgacacgagggaccgcatctgacatggtttctacccttgcgtgttcttgtaagtatacatatttgcatgtacatttgtatggatagctcagtaaactcattatagtttcctttgacatcatcacgtgtcattgggaaacaaatgtaatccaagaccttcaaatgatgttgcagttttaaaaaaataaactgctttctctgctattcccattataaatgcaaccaagcctatggccttatagacttgctggtctcaaagcatgtgtttgaggtgggaaaaaatgtgtcatgtccaaggaaatgatacaagatatactttgaaaatagaactgataggacatagaattggcctgaatgtcaggatgaggcaaaggagatgaggaccaaggcggctgctaggtcttggtgaggagccctgaacaggtgaagagtccccctaccaggaataagaactaggggacttgctaaagcaggaatctttaatttaaaatgcagaaatatttaaagagagaactttaagaatccaaggtataccagctgatgctaaaagacgattagccttgctttgaaacggaagcctagtcagaaaagtaacaattccatcactaagatgttgaaaaaggctcttcaaacattttttgctctgactcacagtaagagatacatagaataaagacattttatcttagaactcagtaatgcatacacataaatacacacataaatatacaaacacacacataactttatgtatgcacaggtgtactgaaacaagctgcagaatatttatcaccactatttgatacacactgatacattctatgctcttttatttcatttttttaaaaagtaaagctgcaatccatgaaactgatttcacaacctattagtaggtgaacccaaagtgtgaaaaaccattatcccataatattaagtggccacaacatagtgttagtttcattctttatggtggttcctatttttccagattctttcccataatcctatgccatctgtatcaggtagacaaactttacagttaattttcaatgtgttttgccaataagcccagtgtcttaaattccttttgggttgctaacacagaccaggtaagcatagtcactgtgggttgaagtgccgtgctctgaccttccttcacttattttttcctttttgtatgtgttgctttttaatcagcactgtattgtgcacccacaactggaacagacagtcaacctgaaatacacattcccttccagccccaaaatgcagaaatcttgtgggacagtaaataatgctgatgtacctcttctaaacatgagtccgcctgatacaacgagcacatccaatagcattctcttccttcccctttccatatctctataaagggctactttcaattccccaaagtccaaaataagtcagccatggacagccagtgccacaccccgtggttcttattcctggcaggaggactcttcacctgttcagggctcttcaccaagacctagcagccaccttggtcctcatcgcctttgcctcatcctggcattcaggcgagttctatgtcctatcagttctattttcttttttttttttttttttttttgagacggagtctcgctctgtcgcccaggctggagtgcagtggcacgatctcggctcactgcaggctccgcctcccgggttcccgccattctcctgcctcagcctcccgagcagctgggactacaggcgcccgccaccacgcccggctaattttttgcatttttagtagagacggggtttcaccgtgttagccaggatggtctcgatctcctgaccttgtgatccgcccgcctcggcctcccaaagtgctgggattacaggcgcgagccaccgcgcccggcctcagttctattttcaaaccatatcctgtgtcagttccttggatatgccacagtttttcccgcctcaaacatacttttcctttaaccttgttcttagctctacttatccatgaataatcccttcttatcttcctaccttctgtggctctgctgaagtgcacgtcctcagaaatccttacatacacaccccactccaaacccccaccatctaaacagctcttctctttactagagtcaacttctgtttctcaattcatgtaaatgcatttatgagagtggatttattttctttgtcaatgtactctttttgtctgtgttcccaactgaaatatttgctttcaaatgtcagtggccaaaaccatcttgttcatcgtataaataaataaatacaatttataagttttacgagcttctttggttctttaataaaaaattcttgaagtgattcatttaaaagtaaaggaattatacaattatattctttctaaggattcattattttaaacaactagaaatctaactagagcaaagattagtgacagacttgaatatctgcacaaagatctgatcattaacaaactaaatagggtaattaggtatacagttggaatgcagtatgcaggcttaaattagtagtgtataattgagcctcatttaactgcaggagaatttcactgagagaattttatttacataaaagaaatgtcttagtgaaattgctttgagagaatttaaaatatgtacaccaaatctctccttacatactggatccagcagaattgtaagcttattcctcatgccccatgtgatggtgttatttctagccaaatgatttcttccaggcggctcaagatccacgctggggcttcattatttcttggatatcttgatgatactctcataaacataataggctccaaagaaggttaaataaaatgatatggtgagagctctgccccctcaatatgatcccttattttactgatcctatttttagaaaaaaactcgaagtatgtatatcttctaaacagtcacttaatttagcactgtgcaaacctttgggggcagcaggtaagtggggcaaacaagaggatccctttgtcttcagagaggcaactgccattttgaggaggcagctctgacacccaaatcaactggactgatgcaattatgtgtgaaatggggaattatcacagaagttcaggaagagacagagatcagctacatggcagattcaacttttgtgtgaggtatttggaggggagggaatacaaagaccagggtgaatattgaaagtctccccttctgcttttaggcaagtccaggtagcgaccagcttgaaaagcaagcataataaaagccctctttgacgcatctactcccgacagcaacatcatcctaaatttatctccttctatgttgtgtgttacatgggtttggtttacgtctactgtgtccatatgctcaccacccactgacatctttttccaaaatacattttaactacccaagaagcacattaatagagtcttcttttaagatactcaaatacgtgacagtgggaaatgaaacataatttctcctccccttcctctaatccactcatgatttcagaggcaaccacagttaacatttgggcagatatctgctgatccaggcctctctgttcatttgcatacacaaatttattcatataccactgcctttggtacataacattacagattgttatgtaaccactttagactatgtagtggagatttttctgcagggtatgtgtacatataccttactgtcttttatgtaactgcagagtatagatgtaccctaatttatttacttatttatcccttgattggcattcaggtttatgtataagttttcattgttggccgggcgcggtggctcacgcctgtaatcccagcactttgggaggccgaggcgggcggatcacgaggtcaggagatcgagaccatcctggctaacacggtgaaaccccgtctctactaaaaatacaaaaaaaattagccgggcgtggtagcgggcgcctgtagtcccagctactcgggaggctgaggcaggagaatggcgtgaacctgggaggcggagcttgcagtgagccgagatcgcgccactgcactccagcctgggcgacagagcgagactccgtctcaaaaaaaaaaaaaaaaaaaaaaaaaaaaaaaaaaaaaaaaaaaaaaaaaaaaaaataagttttcattgttaaattatgcatccgtgcatttgggggtgaacgtcaaagtgtgcacttctgagtttttccataggataatctttgacgttgcaagagggattgaaaagtatgcaagtctcacacttgaaatatactggcaagttgcccttcaaaaatcaaaaggcttcaccaatttacatgcccacctatagaggtttttatttcccataccttttgtcaagaccacttattttcaaacattttattttttgttctaatctcctgtatgaaaagaatctctcattttaatttacattgatttgttcaagttctaagtaaattttgttcagcaattaattaaaacgtaattcatttcacttgtgaaaaggtgacatttttgcaatattaagttgactaatcctagatttggatatgcctcttcatttatccagggcttctattatgtcatttggtaatgacgtggagtgttctttaactcaattttgtgcatttctagctcttagacacttaatatttttattggttcagcaagaatattttatcatattttattacagattagagctactctaaagtgcttttctctgtcaggttcttacatggatgttcttatttaatatcatgattttcccaaaaaggcaatattgcccctttgtacaggttgtatatgtactcaaggctatggcaataggaaggcagggagctgaggccctttgcagcatcctttagaagtcctctcctcccctggctttcttagcgccacactggcttgtgtcctccatgcctcctctcactcctttcctgggtcttttcttggccttcttccttcactcgccttccttcactccccttcctggggagttactaaacttcagttctcatgaagggcttctcctcaacaagcatagtttggtctccaacgccctgtctgcagcttgacttttttgattttaactgactcagcatgctcacagctgagctcttatcttttctgaaacagaatctcccctaccccaactcctttgttctaccaaggccaccccaaccccataggtccctcagaatcaatacctggcatcttcttctcctcaccccagctctgttgaacctttaggttaaatttctttctgtgctcatggcttctgccccactctggttgtacctccgcttgcccatgccttgccgtctcacacttgtgccatggcccaaacccaggggagcgatttgcgtgagggcatgagccagcaagccagggcaccatcctggcacagatacttctagttgtataaactggggcaagtccctgaacttctctgtttctcaattttctcatctgaaaaatgggaataacagtatcttcctcttggggtcattgtaagaactaaatgtgtcataacataaataatgccgaaagcagtggtagcctccacctagaacctgttggctctgattaggattcatgttaatatccatgtctctatctaaattttccctttttataaggacacaccggtcacattggattaggggcacacactatccaagtatgagttcatcttaagatattacatctgcagtgactgaccctatttccaaataaagtcacatcccgaggtactgcaggttaggacattaacataaatttttgaggaagggggaaattcagctcataacgtcaggttagatgtcttctctttagggggctcttcttttctcttatatgcagctttcaacatgtgcatatttttatctggcaactcaattgctcaggaaatatctgtagctcgttcatgcctgcatgtaatcctttatatatatcatatatatgatatatagatatctatataagatatatatgatatatatgatatatagatatctatataagatatatagatatcgatatctatataagatatatagatatcgatatctatataagatatatagatatcgatataagatatatagatatcgatataagatatatagatatcgatataagatatatcgatatctatataagatatatagatatcgatataagatatatagatatctatataagatatatagatatctatataagatatatagatatctatataagatatatagatatctatataagatatatatgatatagatatatatatatcttctatttccacttctattttagttaatgctaagaggatcatgtggtttctaatgctatatacttagaacttagatttaattcttatgttcctctaatatttcagaaactgttattgaaacggctttgaagaaagctgagtttcatgacacagtgtggccatcaattggcgacggcaggcgcagctgagaaaagcttcatcgtgcttgtgctaccatttaacatcttattagcagagccatctcttctttcaattgctattaactcaattcatatagactgcaataggaaaaacacaacaacaagagctctaagatatatttctctaagtgaaaaatgacatatgcttttaaaatcttcccccaaatagtattgcctttactgaagatctaacagcttaaccacacagtaaaaagccagggagcataatgaaagaataattcatcacaatcttaaaatatgctcattttcatataagaatatattcatctctggaggagaacaaactctttttatgcagtctacatgaggaaatgtgccgaaatctaaaaaaaggtactttagctttctttttactgagacctaggaaaggatgttttgaatacaagcaataatagactgtttcatccacccatgcatgcattcaacaaatattttaggatgtcatagccaagtactgttctatgtaatggagatgaaatgttgaacaagacaaaatgagttcttgctattctagatgaaggagggaaatgttaaaccaatctcatgcacatgtacaagataacgtcacatacaggtataataaaaccaagtctctcatcatgaatgaccatgatcatgtgactttgctggaaatttgacttaaaaactgaggccaggatgacaagaaggacccatccagggagagatctgggctcagagcctccagtcagagcaattaaaagaagtacagcatggcctgggtatggtggaagaaggagagagtggagtggaagcttttggagatatggccaaagcccaaactatcatagaccatcataagtggttaggtctagtgggattccatcaaggcactaaatgatgtatattgctaaatgctcatgcatgttgaatagagattaaattgtagggaagcagaagtggacacagagagtttgaaagctacaatccttagatgtgtgtggtacagtgttgagggaggaaagtggatggattcaggatatattttggaggtagaagcagagggccttcctgttagataaaatatgatggacaagaaatgattaattttgagaacttcaggatattttttttatactcagatactaacagatatgccagggagaattgttcaagtaacatgataatgattttggggaaagtccctgagtttctgtgaatatccatttctactgtggaaaagacttctgaagataatatcttggtcagcttgggctactatcacaaaatagcatggactgggaggcttaaaccacaaaaatttatctctcactgttctggaggctgggaagtccaagatcaaggtattggcagatttggtgcctgatgggggctcccttcctggattgcagacagccgccttctcactgcgatcccacagggcggaaagagaaagtgaggtctggtcccacccttataatcacacctatacctaattacttcccaaaagctttatttccaaatactgtcatattggggattaagaattcatcatataaattttgtgcagatgcaaacattcagttcatagcagatgtctgtgatcctcctttccccaagcctttcactggggtatacaaaaatactccatggactcagtatatctttctatgtttaccaatgctctgtcatgtgacattggctcagaggtttagtaaatattttgcctgtggtgaaatagctccaaatggcagaattatgatgtaaaattcatctacatcattaccactcagatgctttctttaatatatgcggttgcctttcataagtaagcaaacaagcaattgaaagggggccctgctatgtttatgtcagtgggatcttccctgtctggctcacaaaggctacattttatacacctgtggattgtccagaacagcagaataacaaacatggcatttactaggatagataccaatttaattttttatttattaatatttttttcaattgaaaagttatatacatttattgggtacaatgtgttgattttgtatgtgtctatatatacacacctatgtgtatacacgatgtgaaatgattacatcaagatgatgaacatatctaccacctcacttatccctttttttgtgatttgaaatttactctctgagctattttgaaatatagaatacattattattcagcttagtcactctgctgtgcagtagatgcatgactatctgctagatgacataaatgcattttaatttgatcttcaacagcagaacaaagagattactcatcatctctcttttttctagatgaagaaagcaaagtttagagttaaatgactagactgaggccacacagctggaaagggacaaggaccgttttgtagttcagatccactggcttccaaagcccaggttttttcttccacactgagaaatctctcaaagtggatgagcttattgcacctcaaaccagggaaaatcttttaatttgattcttcataagaacaagaaaaagttagctgagaagattgaacaagcacattaatgatgaggactttaacatataaaattaagtatttgtattagaataacacacaaggataaaagcaggtatggggataaataccagttttcctccctgggtatcagtagccccttcatcccagggagacaaggacaatgccacttccttgattgctctccaggttcttcccttctatcctttttcctcaacttcttgggatgttcctaaacccaaaggctcaaatctgtttagattataagctccctagagataggggctgtctctctcctttttgcatttctggagcctaggacagtgctggtccaacgaatgggtgcatcacttggctctgtttcctgaccacctataacacctgctggtttctagaatcaactctgatgtgcctctttctggagatcatgcatgcctgctttctgcggctcagatcttaaagatctgactttcagcattaacaacccatagttcagcaaaatagatttctagaactgctgctattttaatatctgcctttgaagaaaacccaaaatggtgttgtgcctgagtttcagaacccactgctctatgagtgttttttgcggctcagctccgtgacaatgggaagaacgtggctgtagaactccaaatctgagggtttctgcaacattttcctactgggctaatgccccattttctttggtagttttgtgtccctacatagaaatatcccactggcccctatgctaatcttaaccaggctgactgaactgacaccaagcgctggatttattttagtggcactaacatgtaagctcatgttaactgatgttggaaaaccactatgttacttgctcataacctatttactcttagtttatacaaagtcctaaaagccttgatatgtctgttttctaactctcagcatactgaatgcatcacactgtgtgttgacaaagatactgataacaaagggaagtaacatataacagctggatagtaaaggaggaagcagaaaagctaataaagacaagctcagagacttgaacatctggcagtctgggaccattccatgcatcttgagatgccacatagcttctgagacatccctctggtaactgagcagcatggctcaataatcgatgtccaaaatgatgactcaaaatccaaaaatcattccctgttcagtaggctctaaattgcagtgtgtctaacatgacaaaaagtatgaactatgttttagaactgtgtccggttaaaatgctaatagtattccaaggaaaataaaacagaaagacacacaaagggagacagaatgagacagaattgtgtgtttgcactttttgctgccaataaattgtatttaaacatttgcctattttaacagaagcacatccattaatcccattgaaggacatgaacaaaccatttaatccatatgacatggaaacctttggtggcataaggtagcaagtggggtacagtggcaagttagggagcagttaaaatgattccttgttaccacagggctgacatatttggtgctctaatgacttagctgtgtccttgttgtcccttgatagttccacaggactcctgagttgagactgtacccaaggaccctggacttacctgttcctctcataattaaaagatcctacttttcaaccttattttatgttttaaaatgttgatcaatttcaagatgagataaattgagaaatgaaggactagacaaaggaggtcaaattaacccatttatgcctgaggttgcaattttttaaatttttgcaatcagaccttggcaatgaccttgagcagcaggaaataaataattgccacatgcttagcgttccaataatgaaacgctaggcttaaatgggtttacgcacagaaactcagttaatgtcaactccttcattcctgtaaacatctcaaaaaatgcttaagacaatcaaaggttcaagttcttctgaaatgatacgccctaaagccttatttaacgtaagtgggtaaacgaaaaaaatgttagatattacaagaacaaaatgttcctagagaatagagccctctctggaatcagtaataatgcaggctgctgctatctgtgtgcatttctcaacctttctggaaaatggcacacaaaatccttcccacttgtattttgccaccactcatggcctatcaattctaatgaaaatactccacgctaagaaggtgacaggaattacatacatcatctttttttttttttgactttcctttctgtctatcaaactgtactttaaaggaactgattattaaagcattatgtaagtatgcaaaatatattgaaagagaaataatgtttccattatacacaatgtgtatcataagaaaggctggtgtgtgatgacacatgacaagtggtaaaaggtatttttagttgctttcattttggggaataataaagcaaaattatctggaatatacagcattaggagatttttcagcttctctaatagctagcattatttatggcatattttaaactaaatgtctaactggaattgtttggaaagttaatatagatattactttaaagatattttatactacctttaataattaatttgcgctcctttgaaaagcttatacaaggtcagtatttgctctgttattttatgatctttttcacatctgtgttctttggaattactcctaactcatgataattcataaatcatttttaggctgggcatggtggctcatgcctgtaatcccactttgggagggattacactccctggcactttgggaggccaagacgggtggatcacttgagctcatgagttcaagaccagcctgggcaacatggtgagatctcgtctctataaaaaaatacaaaaattagccaggtgtgatggcccactcccatagttccagctattcgggaggctgaggtggaaggattgcttgagctcaggaggtgatggctgcagtgagctgagatgataccactgcaccacagcctggataatacagccagaccttatctcaaaaaaaaaaaccataaaccatttttaatttatctgagaaactgacctatgcatgatgtgtagttactgcagaaaatgaccaagaaattatctttacaatttaaatatgtaaagctcaaaagcaatgaagctaagactcctggaaattctgactgaaataaactaaaggatgtttcaactgaacctgagaaaaataagcaataaaagttgattatttggcattttagtcttttttcaaagataaaaatcacattctttctagtggaatcacatcacatgcagaaatagcccatagaagagtctaacggtggcaggaggtgtactgagttacccaccgggaaggtgcaatgaggcactctcagctctactttttttttttttttaaagtaaaagaccagaaattttattatcttagggaaattatagaatccacttacgatgatcatttacattttacctttatgctccaacttgttttatcagccaattaaaattgaacagcgaaaaatatctttaaaagttacattttcaaagggaaaaaaacatttttgccctcttaaactaacactgatatttgatctcaatgttggccctttctgttcaactgaagctttaccggtaaaaattagaggttacagataggacattgttttgtgctgacataatggggaatgactgatcatgaattttttttcttgaggtgaaaattgttattgttagtgatttgaacagtccctttaaaaattagtgattaagaaataacagagtattctaaaacactgaatctgggaagaattgatatgtgtcatagaatatagtgataaatattggttattaatgtgaggaaataagacagcctttttaggggaagtttgtagaatattttattgctttgtagtctaatatttttgtgcttttattgaaacattttaaactgaggcaaaagtttatactttcataagctagagatgtgcaacaaaaagttaatattcccttaatttgtcacattctaagggaaatgtaatgatccaagaaaatcttctgtgttcggtatataccaattatatgacaacttcgttgctgtaagataaatgcatgatctaaaaaaaagtttatgaggttagatttgctaagtatatatttattgtatagcataaggactaaaaacccttaatgtaggctagtcaaaaaattaaaacagcttggacccttaattgacacacacacacacacacacacacacacacacacacgcagacgcacgcacccatttttagccttttcattaagtttcttcaggtgggggaaaaaaaaaactgtttaaggactttgtctgtgtggttgggttgctttcattgtcttttaaccaagccactgttttcctctatttcaggatctagatttctcatcacatccacgggagccttgtatattaaagatgtacagaatgaagatggattgtataactaccgctgcatcacgcggcatcgatacaccggagagacgaggcagagcaacagcgccagactttttgtatcaggtaaaaacttatcaagactctgtctgctatgtctgctatttctttgttagtgtcctgagacgactcaatcaaaattgtggagtgttgccactaaaatggagccttcaattccttttccaaaatattttaggaattttaaaactcttttaaatgaatatgagtacaatttcatagaaatacagatttcacatttgtcaaaccagtaattgacacattcacataatgatgcgttagcatttcagggagcacattaggagtgaaagatccatctccatcccaaatatccatctcaaatgcagtcaaattgcatttgatttgattataaaaccaaatacaaaatacccaacctttgcctttgtagctgaagaatataaaattgcccccctgtggtaaatatcctataaggttgtaatagtgagatggaagtgaccaaaggttgcttgctatcaatatttgagaagtaccttatttgtaataatgctttatgggaagaagtgaagggaacttgttgaacattggaataatttaaaacatcactgcctgagcacccactttttgtccttgataatgtactgttgggatttttctcttcatcacttacatcttcaaaatagccaatagtctttcaaggtccagcacaaatacaagtcagaattaaattagttttcctttgaacttgcaagtatttttgtttctttatctgttcttttacaagtcaattgctattttctcccttgcttttatagttatcatgtcttttgggggaaaaatgaattagaaaatgaataataactatcatcttagtccatgatagctttaaggagagcacaatattctgcttattcagaaaatcctagaaaacgtcctctttgtgttaaagagaaattttctaatggcatgttcagaaaagaaaggggaaggattcgaggtaggagggggatcctgatataaaattaatttgggattcgcaaaattagtaaataagcatttctccctccaaatgatgacataagtggtgatgatctaagagcccgtctttctgtttcaggtgaccttttttatcttcatgctgaatcatcaagtgttgatttttaaatgtatctctcagggttggaaaggcaagtttactttccttaatcccacgatgtttgttcattttttgttttggagtgattcactaatgtttcaaaaatggacagaagtagtcacaagcattttgtcaccatgggagtcctaggattgcctagtgagcattggaaaagtgagagcaacaatgtataatccagccagggaatatcatacactaagccacctgccgaaaagtagccaaggaataagactgagcattcaggactaacagtatagatgaagacagggaggtgatagatgccaggagaagggaggggtccacagagtcacatgccacaaaaaggctcatatgagagtctaccatatgtggaaaataactcaatattttttgtcattgaaattttaataaagcagttgaggaagaaatttgttaatgctaaaagatgagactgtagacactgaatacagaatgcatttctaacatgtcaagctttgaaggaaaagagaaattaatttcattttaaattagatttaaatatactgaaaaatgtacatctggagtttgggtcatggtggaaacatgttggtgtttgaccccaaactcctcctgaaaccaacacagataaaataggatgacaaagaaaaaagtacatggatggcaccttcaacacaactggattactggcaacaacaggaccagcagcagaggtggaaggcagtagaaggggtcagcctgttgggtttatggtagtgtcagaaaactgcaaataaccaacgggtccccatctccaaaagcagaggagaattctttgtgtcttagagtcctcacaacactgggatagaactgcatgaggtctaggttggagatgagtcacaaggccattagagtggctggtaatgtttgcacaggccagtgatggtctatgtccttgaagatagtggaagtactcagcaagtactcctttcagaagaacagagactcactctcaggggaacggctcaatttagaaatcaaattgagccagagtagaatacaaagagtaacagagaaggctcgggaaccaggggaggccctagagaattccatcctatgaaatactgcaaaagaaaatacaacacgcacagccttagaatgtaaaaaacagtgttctaggaaacacatggccagaagtggaagcccatacagttcaatcccatatagctctgagagatgggctaaatgtcgagtccttgaaggtaatatcaagggagaagactggaaaaatatactcatttcatcctctcctgcaggaaccttctcctaattaactaagaatctctatcttattgtaaaatgaaacaaaaaggaaaaagatttaacccaacacaactttatcacaagaaaaagaatgaaaatttttaaaaaagttttgattataagtaactacaaaaaatactgacaaatcatatgaaaactatatttttttgtttgaaatgattaaagctttgaaagagcagtataaatcagaaataaaatgatgaaacaacacaaatctgtgaaacaaaaagtggcatattttggaaaaagttagaaaaatgaagagttctaaaattaaaatgaaatgacagggaacacatcagaggataaacacaacagaaagcataatatgggaaatcaaaaatattaaggaataagacaaatagagttaaaaatgtatagatgtctgacaaagatgatgaaacacatgtataactaaattctcttaaaaagaaagccaagcaattgatgagaataagtattaataataaaacactaattcaaaaaaagtctcctgtcattaaaaagaatgcataatgactacatattaaaatggcacaaccctacctggaaaaatggacccagaatggtcaacatgcaacatagtctaataaaatttttgagctgtaaagataaagaaaaatatcatttagacagccagaaaataagttcaagttacttctaagggagaatataaacagactaatgaaatagaaaatagaccaaaagaacagtaaatgtaataaacaagttttttctttaaaaaaaaagtcagtaaaatagacaaactgacctaatattttttaaaatggtcttgatttctgtgctagggctagttatttggacaagtcattctttctctgaggataactagaaagacttgttaaatgtgtaaaaaacatctgctcatggctgttaggagctagagtgaaaacttacaggaccaaattccagaggaaaacagccacaagaagtgagtttggtattgaggactgccttttcagtagggacagttttagaggagattgctgaaactccgagaagatgagcaactcttctgaaaggttagtagtgtctagaaggtaaaaattggagtctagtctctatatatgtattagggttctttagggggacagaattaataggatagatgtatatataaagtagagtttattaaggagtaatgactcacgtgatcacaaggtaaagtcccacaataggccgtctgcaagctgaggagaaagaaagtcagtctaattcccaaaaccttcaaagtagggaagccaacagtgcacccttcagtctgtggtcgaaggtccaagcgtctaaaagttgaagaacttggagtctgatgctcaagggcaggaagcatccagcacgggagaaagatgtaggctggaggactaagccagtctagtctttccatgttcctctgcctgcttttatcctagccatactggcagttgattaatggtgcccacccagattgagggtgggtctgcctctcccagttcactgactcaaatgttaatctcctttggtgacaccctcacagacacacccaggaacaatactttgcatccttcaatccaattaagttgacactcaatattaatcatcacattaaatatatttgtttatatattatatattatagatactcatttttatttatagtagcatatatagtgggataagtgaaaagtgattatgtttatgttatttttatttttattttcagtataagagaaaaataaaagtatgaaattcttttataattcttgaaaatttatagaaattcttgaaatataacaaaaatgtaaggcatttatacaactgaaataattatttctaaatactttacatatgtactttttatcctaagctctaagagaacagatgtgccttagtgtgtatatatatgtatgtgtgtatatatatatatatatatgtatatatactagtgtgtgtatatatatatatgtatatatactactgtgtgtgtatatatatatatatatacacttttttttaattgtactttaagttttagggtacacgtgcataacgtacaggtatgttacatatgtatatatgtgccatgttggtgtgctgcacccattaactcgtcatttaacattaggtatatctcccagtgctatccctcccccctccccccatcccacaacaggccccggtgtgtgatgttccccttcctgtgtccatgtgttctcattgttcaattcccacctatgagtgagaacatgcggtgtttggttttttgtccttgcgacagtttgctgagaatgatggtttccagcttcatctatgtccctacaaaggacatgaactcatcattttttatggctgcatagtattccatggtgtatatgtgccactttttcttaatccagtctatcattgttgggcatttgggttggttccaagtctttgctattgtgaataatgcctcaataaacatacgtgtgcatgtgtctttatagcagcatgatttatattactttgggtatatacccagtaatgggatggctgggtcaaatggtatttctagttctcgatccctgaggaatcgccacactgactttcacaatgtttgaactagtttacagtcccaccaacagtgtaaaagtgttcctatttctccacatcctctccagcacctgttgtttcctgactttttaatgatcaccattctaactggtgtaagatggtatctcattgtggttttgatttgcatttctctaatggccagtgatgatgagcattttttcatgtgtcttttggctgcataaatgtcttcttttgagaagtgtctgttcatatcctttgcccacttgttgatggtgttgtttgtttttcttgtaaatttgtttgagttcattgtagattctggatattagccctttgtcagatgagtagattgcaaaaattttctcctattctgtaggttgcctgttcactctgatggtagtttcttttgctgtgcagaagatctttagtttaattagatcccatttgtcaattttggcttttgttggcattgcttttggtgttttagacatgaagtcctttccctaaattttaaaaaatgcataaaatccttgaaatgtcaaattccaatagaaactattggtatttgtggtatgcgtggtggctcacacctgtaatctcagcactttgggagaccgaggcaggcagaccacttgaggtcaggagttcaagaccagcctggctaacatgatgaaaccccatctctactaaaaatacaaaaattacccaggtatagtggtgggtgcctgtaatcccagctactcaggaggctgaggcaggagaattgcttgaactcaggaggcagaggttgcagtgagccaagatggcaccattgcactccagcctggtgacaagagtgaacttccatctcaaaaaaaaaaaaaaaaaagaacacaaaaaactattggtacacacttcaaaaaaaaagtatgaattttcagtctttccactgagaagtcccagaagtgatgagcaaacaatagcaacaagcccctctaacatctagattgtagattcttttaaatataattcactactaaaagggaccatggcttcttggaggagtggctgattgaaggtctgaggcaggaaatgtctgaggtgagtctgaaacatgaatggggtcttgtcaaaatgacataggaatcaacataaagcggctctcgtcagccaaaggggatgaattgagtatcagcagtgatgcttgcacatgattgataaccattaaatattttgaaaacctttgagttcattttaattttatacatacatgtgtgtgtatatatagatatatacacatatgtacatatatacttacatatgcacacctgcatatatatttcatataaagaaagaaagaagaatcttattggtctgcatagtagaaaccagggcactaactcttcattctgataacagatgattaaagacaacaaccactaaatgtattgtctttcctatagctgctgtattttaagataaccaaataaccttagttcagaagggaaagttcattctgcagaataattatatctactgaatgcgaacgaaatgacacaattagaaaattccattttcaaccttagcaaaatagctcagataaattttaacatctgacctcactgaacaattgagtgtcactaagaacgggaaaaccatacattttgtggaagcaatgtgaagtgcacagcacccctctcaaagagagagaggttgaacacttatctaaccaacccactgaaataaattccagttcataagaaaaatgcctatggcaataacggaacaagttaaatgatgacatggacaagcaaattcagcatggtaactacctggtttctttttttttattattattatactttaagttttagggtacatatgctgctataaagacacatgcacacgtatgtttattgcggcactattcacaatagcaaagacttggaaccaacccaaatgtccaacaatgatagactggattaagaaaacgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcatagatgggaattgaacaatgagaacacatggacacaggagggggaacatcatacctggtttctttaaaaagccaagtcaaatacatgggagaaaggaggagggctagctctgcattaagaaacactcaagagatgtaacaactgcatgtgagcaagagaaggatcttgatttaattaattcaattgtttaaaagctagccacttttgagctgatgaggaaaaatgaattgggagtgtataatacttgatattatgtaatactgactgtggttatgtaacaaaaccgtatttttattagggaaacatgctagtcatgtaatgataaaatgacatagcttcccttttttgttttttgttgttgtttgtttgtttgtttgtttgtttttgagatggagtctcactctgttgccacactggagtgcagtggtacaatctcagctcacttcgatctctgcctcccgggttcaagtgattcccctgcctcagcctcctgagtagctgggactacaggcatgcaccaccacacccagctaattttttgtgttttagtagagacagggtttcaccatgttggccaggatgggctcgatctcctgaccttgtgatccccctgcctcggcctcccaaagtgctgggattacaggcgtgagccgctgcacccagcctatagtttcccttttgttgcatatactttaccaccaaaaacaaagtaaaactatcaagaaataaacatgacgaaaaatagaaaaggtttggtgccagagccattaatatgatgaatatatgggatgcgtcatattatttttgtctacttttctgtacgttttcaaatgtttggggtaaaaataatttttgtaatatatatatatatataaaagtttgaagactttgagacaaaaaaaaatttgaaggggatgaaaatgaaagacaatgccgttcggttattcagatttgatatatgaccaaatatccccacaagagcctgtctcaagcattgcttcaatcatgcacttaaaatataaaacatcagatgctgtgagggtgcagagaaaagggaacacttatacactactggtggtaaagtaacttagtcctgccattgtggaaagcagactggagatttctcaaagaacttaaaatagagctaccatttgacccagcaatcccattactgagtaatatatccaaaagaaaataaatcattcttccaaaaagacatatgcacttgtatgttcatcgctgggctattcacaatagcaaagacatgaaatcagcccaggtgtccatcaatggtagattggataaataaaatgtggtacatatacaccatggtatactggaaagccataaaaaagaatgaaatctcattctttgcagcaatgtggatggagctggaggccataattcttagtaaattaacataggaacagaaaaccaagtacctcatgttctcacttataagtaagagctaaatattgaccacacatggacacaaatacaggaacaatagacactgtggacactagactgtggaaggcagagagtttaggttaaaaagctacctatcaagggccaggcacagtggctcacacctgtaatcccagcactttgggaggcctagatgggcggatcacaaggtcaggagatagagaccatcctggctaacacggtgaaaccccgcctctagtaaaaatacaaaaaaaattagccgggcgtggtggtaggcgcctgtagtcccagctactcgggaggctaaggcaggagaatggtgtgaaccccgggaggcagagcttgcagtgagctaagatcacgccactgcactctagcgtgggcaactgagcgagactctgtctcaaaaaaaaaaaaaaaaaaaaaaaaaagactacctatgaagtaccatgctcactacctgaggaacaggatctctactccaaacctcagcatcacgtaatattcccatgtaacaaatctgcacatataccgcctatatctaaaataaaagttgaaataaaaaaataaatacctcattcaggtttcgtaaaacagttttgttgagaggtagtttactttaatataaactccatccggtttattcaattcaataattttagtaaatgcatggagtcgtgccacaattacgccaatttaattttagaatattttcaccacccaaaagattcctcctacccgtttgaagccaatttcaatgtccatccccagtcccagacaaccactaatctatggtctgtctctgtagagttgcattttctggatatttcacataaattgatatatggattttgtgtctgccttctttcatgcagcacccatgttgttacatgtattagtcattcattctctcttgttgctggagagcatttgctcatctgtaaatactgcatttggttatcaattcactaaattatgaatatttgggttgtttccactttttgattatgaataatcctgctatggacatttgtacctaagtctttgagtgaacatgttttcattcatttagggtagatacctagaacttggggccttatggcaaattgaagtttaaacactttaagaaaatgccaacttgttttggctgcttttatttggcaagtataccacaatacacctggggaaaaaataaactctagccaatgtgatgtaagaggagaaaaatgtgtgggtttgtaggaaattctgcttaaaagtgacttcactgagggggcattcttaagcatttttgctgtgatgtggatgtgaaggctggcactccagcaagccatttttacgtgagatgtatatgtgtgcatatgtaagtatatattaccttccaccaacgatgtatgaagattccaggtccccatatcttcaccagcattgtttgtgattttattgcagtcatcctaatgggtgtgaagtcatgtcttactgtgattttaattcatattaccctaatgcctagtaatattgagcatctttttgtgtactgattaggtatttgtgtatcttctttggtgatgtaaaatagtcaactattttgcccattttgattgggttgtttcttttcattatagagatataagcatttttaatattttttggatttgagttctttattagaaatatgattttcaattttttttcactttctaaatggtgcctttgaaaatgctacagttcttaatttttttttttttttttcgagatggagtcttgctttgttgcccaggctggaatgcagtggcatgatcttggctcactgcaacctccgcttcccgggttcaagctattatcctgcctctgcctgtagctgggattacaggctcatgccaccacacctggctaatttttgtatttttagtagagacggggttccaccatgttggccaggctcgtcttgaactcttcacctcatgtgatctgcctgcctcggcctcccagagtgctgggattacaggcgtgagtcaccgcactgggccagttcttaattttgaagaagtttattatgttgattttttctgtttttgcttgttttcttagtgttatgcctaagaactcttcaaggtcatgaagatattttccctatgttttcttctaaaagtttttatagttttagctgttatatttaggccataatccattttgagttaatttttgtaggtagtgtgaggcaaggttctaaattattttccatgtggatatccagttgtctcagccattttttaaaaatgtcattagaattacatagcactatcttaagcatatttgagaaatttctgccaagtttcagttagaataaaactttttaagtgcagtcattgagagttgattttttatgaatagcattagaagttggtgcatttcattttcagagattgtgggattattctgcaaagaaagtcagaggtgcacactgtggtgtttattgtcagccacccctgccaaaggggtgacatctttgtgccaccttctccaactctacttctacttcctactctaagtaaaatgacagattttgcagctattttttcatagtactttctaatatcttcaatattccactctagtgtaactaaaatctgtattactgaagaacgagagctatcattatattctcacattttttgtttttgtttttttttattatactttaagttttagggtacatgtgcacaacgtgcaggttcgttacatatatatacatgtgccatgttgttgtgctgcacccattaactcgttatttaacattaggtatatctcctaatgctatctctcccccctccccgcaccccacaacaggccctggtgtgtgatgttccccttcctgtgtccaattctcacatttcttaattaaatgaagacagagttcagaataatagagaagcttaccccaagtaatacatattatcttggatgtgatttctacttactaaacaatattgcaatggtgtttatatggtctgcaagttagtgtactaggaattaaaaaatcccatgtggttaaggatgtccaggaccatttctggagctggctttaggcacaactttgtgtcttctagttcactgaacccattgggtgtgcaggtgatgatacttccagtaacatggatgcagacagctaaccatttttctggattcttggttcatgctagaagatgccagagatcagtgagacatcattggttaggcctgtctccacttaattattcagtctatgggaacataacttgatcttcaaaccaatacttttcaaagtccgtttgtaatttcctttagaagcaggtaaatgaagcaatgaagtttttgctggcacaggctctgtacctgggtattgtgaaacttttatatctctcttgccttctggagccctatagtcatgcatatgaatgactgtaattctggaatatagaattcttcagttaatgaagaattagaggagtcctggaagctcatcaagtattctttaaaagagtatttaggttccctcattatatcactgtcataagacaccagtgaagtaaaaagagcagcaagttcataatgaagttttatctctgatgatcacaaaagaaatagaaagccaagacatttcagctaaatgtttttgttctattttcaacagtgcctgctgactgccctcagtggctgactacggaatcacagcctcttaaagaagtcttcctactaataaatgattttttgatgttattgtttattaaaacagaaatttactctcttgtatataagtccagaagctggtttgccagcttcagtttcacaagggaccaggcttttatctttctgatccattatcctcacgtgcagttccattctcaatatgatttcaaagtccaaagtgattgctgcagctcctacctttatatccaccttccaggtgatgtaaagaagcaaaggaaaaatgcataaaaacacccctcccagctaagtcgcctttaagcagaatttcctacaaatccacacattttcgcctgttacatctccttggctagagtttatttttcctccaggttaattgaggtattgaaaaatgaaaattgtatatatttaaggtatacaatgtgatgtacaatgtgcatatatatatatatatatatcactatcaagcaaaataacatatctattgcctcacatagttaacatttgtgtgtgtatgtatgtatgtgtgtgtatgtgatgacaatgtttaagatcaactgtctttgcaaatttcaagtatgtaagatagtgttattaactgtagtcactgtgctgcatagtaaacctctagaatctattcatctggcataactgaagctttgtacccttttacctaccatatgatctagcaatcccactctgggtatatatccaaaggaaatgaaattacatatctgcactcccatgtttattgcagaatcattcgcaacagccagaatatgaaaaaaacttaagtgttgatatacatatacacacatgcataggaatatcattcctatatacacaaaggaatattattcagccttaaaaaaggaagcaaatcttcccatttgcaatgacatggatgaacctgaagggcattgtgcttagtgaagtaagccacgcacagaaagacaaacactgtcttttctcacatacatgtgaaatctaaaaaagtcaaactcagagaagcagggaatagagatgttcgtcaaaattacaaagttccagatggctctcatttgataggacagtgaatatccattccttggccatcagatttattgcaggtagatcaaaagagtcatggcatttttctcactgaggcaaagacaagaaaatttcaggtagcaggagtctataacgtttctgtaatatccatgtggaatgcaagggtattgtttcatgcaagttctaaacaggttgaattagaagagagagcagggtgagaacactgagttttacgtttagcatccaatcaggtgctgtattttatattcttcatagtcatgcaaagattatgaccttgggaacatcactccattcaaacaaacttgaaggacattgagctgcgtggtttccacagacccagttcttgagaatattttatcaatttcctcacctggttcaagatgatgtcacagaacaggaaaattatacaaggccctgtcataagtgatcatttgcaagctgctgctttttaatccattgtcttgctacgccacatgctgtcggtagtgctcattcaccttatctcaaataccatcttctcagagagtctgtccctgaggaccatatcttgagtcctcctggctgcctccacacccatagcacgtggacttcactctctgttatgccctctttttctttctttaactacacttattacaaactaaattatctttatttgcttgctaatgtgttgcttgctccccaacaccacccgcccaacagaacatgagctccaggaagacacctgtctcatccaccactctccctttagtccctaactctgtgctggtctacactgagggatcaaaacatatttgtgaaatgaataaataaaatgttttaaaattcaaaagctatgtgtaaaactcttttgtgcaataaattttactaaagttaaacagctatttctgcttatgttgctctttttttttttttttttttttttttgagacagagtttctctctttcacccaggccggactgcagtggcgctatctcggctcactgcaagctctgcctcccaggttcatgccattctcctgcctcagcctcccgagtagctgggactacaggcgcccgccaccacacccagctaattttttgtatttttagtagagacggggtttcaccgtgttagccgggatggtctcgatctcctaacctcgtgatctgcctgccttggcctcccaaagtgctgggattacaggcctgagccaccatgcccggcctagtgttgctctttttttctgtttaaatttatttaggctgggtgtggtggtgcatgcctgtaatcccagcatgttgggaggcccaggcaggaggatcacttgagcccaggagtttgagactgtggtgagcaatcattgcaccactgcactccagcctgagctacagagtgagccactaacttaaaaaatatttattttattaattttatgatattttattgatgcataatagatatatagtttggggtacatgtgataatttaatgtattcatataatttgttaaaatcaaatcagtgtacttgggatatccatcacattatatgtttggcttttctttaagctataattatttcaattcttctgttttagctattttgaaatatacaatacataattgcaaaccatagtcattccactgatctgtctaccactaggtcttatttcttatctcaaattgcatatttgtacccattaaggatcttttaaagagaattctgacattcccagttatgaaaagacaatctgatttttggcctgagctgacagctcttgttgaagcctgctcattctggatcttttattcatttactgaggaatgaccaacagaagctctgaccagtgttcaaccttttgtaaattctgagcagaaaataaattgtatgaatagggcacttctttttctgttcacttataaaatcttaaagatctgtatcaatagttggtatgatgcaccgtatttaagttatacatgaagtcctacaattctaaatgaccacttcaactcctcattcctgcctctaagagtttttatttcttctacagacccagcgaactcagccccatccatactggatgggtttgaccatcgcaaagccatggctgggcagcgtgtggagctgccttgcaaagcgctcgggcaccctgagccagattaccgctggctgaaggacaacatgcccctggaactttcagggaggttccagaagaccgtgacggggctgctcattgagaacattcgcccctcggactcaggcagctatgtttgtgaagtgtccaacagatacggaactgctaaggtgataggccgcctgtacgtgaaacgtaagttggacggtaacttgcaaaggtggtgttggcttccatcgatggagctcctgttataagcaaatctccatgttttctctgtagctttccattaactcccaaaacagtccagctgagatcaacagaaacctcattttacagatgtgaaaattaatgctcagatgaattccccaaggttacacaactggagagtcttggctgtcggatttgatttgaaatctttctgatccccaaacctctgtgatttccattaggccacagactattacatttccaagatatgatttcaagataacacttcctagctgatgaattcacaacaaccagtctctctaaaaatgaacagagagagagggtaggattgttctttcagcacaagtgatggtagccaatcaaagcagttgtcctttgtctgtttccagaccatttctccattaaatttctaaatgaggctattatcacccaaagtacggggctcaaacatacccaaatattagacttgtgcctagtattatagatcatctactccaaatataatggatttatttgatcttctattgattgccttggctgccttgaggaatgtgttcagaaggatactgaaggcagatttggaggaaggagggatgtgatcgcagggtcacaatctaatctactcaaccaccctcaattttgctcttgcagaaaccaaattaaagtgaattacccaagatcacatggccagaaaagggaggcagagcattggtcagagaggaggtcttagttgccaatataatgctccttttttgaaaatatatttttatttgatgaactaaattgaacaaatttaaccacaagaatctcacagtgacaatagaagtgttttcttacttcctcctccccacccagccctaaccctgtttatggaactttctcttcagtgtcaacctgagtgtagactgccttagcgcaacaccagcctaagagaatatatttatattaaatatccaaatgactctctatctggaacaggctgtccagcctgaatcctgcaaatatttgaatatgtttagtctgggattagaaagaaatggatgataaaatccacagtcacacttctatagctgaagaatcatgtggataaaataatgcagcattggacagccagtaagaattattcccacgggctcaaagtctcttctgtgtttaaagacctctcctagctccctgttctccattgaataaagtttatatcttaggatagtactgaaggcatctcaagcaaatctgtctggttgtatttcccattgttttgcattaaaacccacttatgactagtgttccattattggaacactaagcatgtgggagttatttacatcctactgtgcaaggtcatcaccaaggtctgattgcaaaaattcaaaaaaaattgcaacctcaggcataaatgggttaataaaaacctattcctgctaaatctaacttcttcctaatccctgcacaaacctattcctttcctgattgcaagtcacattacttatgttgcttcctccacatggaagattatttcccaatacttggttatctaacacttcccaactctcttagcctccatccacaaagatgtgttgttccccattctcctgtctccttctcaactcagagtatgttactgctttctctctaaaggcgtttatcactacctatattttaaaagcctttattcttaatgtgcttatttttatcattgttcccttcttccacatctaggtgattctccaatgcttctggaatattctctgcctcccttctgactgcttcttctaactgcagaagaaaacagcttcttcgttcctatctctcttctctattggaaggcattctcttgggctccaaattcagaactgtcttcttgtcaagctcttcccttttccttaggctctgtttcatttgtagagcttcgaattccttgcccctgaaaataagctctgaatctgtacttacagccttggcgtccttcctgaatgtcagacaagtgtgtcaaccagctttctttcagaaatttagttggcacttcaaaacaacagggtcggataccaaactgaactctccaccacctcttccttccaaatggctcttgttattattatcaacatcttcctccttctcatccctcagatgcaaacatgaaatgttgggtgccctttaagcctttcctttctacatcctgccaagtcctgccatgtcctgccaagtcatacaaactgaatctcacagttactcagctctgttctcaacctctgtcctgtcctagattggatcttaattgtacctacactagacatgtgtaatgtcttcaatgacgggttttcctcaccctaatttgtcaaaagacctatgacctagtgattccattaaaagtatgtttgtgctgggtgtgatggcttgtgtctgtagtcccagctacccaggaggctgaggcagaaagggagaggagtttcaggctacagaaactcctctgtatgattgtgccactgcactccagcctaggtgacagagcaaggccccaattctaaaaaaaaaaaaaaaaaaaaaaaaaaaagtatgacttatttgctaaacacttttgaatgccttctttagttatctttgtttaattccaaaatctcagggactctctgttgcatccaaaatgaatcagaaattctcagacatgcccctgctccctgccttaattcatgtggttcccaatctctgtgattccctctttccattctgactgatctcagttctatgcacccttgatatctgtggatttcctgctcttcccatccaccctcctccacatgtgctatgtctctaatggcccctccatcactctggttggttattacagccatttattgcctttgtcttatcaacctagaagactgagctccttgaaaacaaagtgtggtgagatgaaaagttaggaacaactggggtaaaaaaaagcttttttttcacccactttttgatggggttgtttgtttttttccttgtaaatttgtttaagttccttgtagactctggatattagaccttagtcagatggatagattgcaaaaattttctcccattctgtaggttgcctgttcattctgatagtttcttttgctgagtaagtagaagcttattagtttaattagatcccatttgtcaattttggcttttgttgcaattgcttttggtgttttagtcatgaagtctttgtccatgcatatgtcctgaatggtattgactaggttttcttctagcgtttctatggttttaggttttacatttaagtctttaatccatcttgagttaattttcgtataaggtgtaaacaaacctgtaggttcagcgcatgtatcccagaacttaaagtgaaataaataataataataataataggagaagattaccagaatggattaaaaagcaaatcttagccatctgccatctacaagagatgtttgttaatttaaaagatatatttatatgtcttctggcctccatttgcttctgctaaacaatcagaggtcattcagatctttgtttctctgtatgtcatttgccatttttgctgtctgctttaaagaatttctctttatttttcgttttccataatttgtaatatgactagacaggattttcatcagattttctctgctcagcactttctgacctttaaaaatctgtaactgtaggtctttcaccaaaaattttgttttgttttgttttgatttgccatttacctgttgattggatttggctgagttatttaagcgctctcaataactattttctgttttgtaaaatagagataacacaaaaattacaggattaggagaagactgacttaaatgatgtatgaaagatagtcgataattttatagcacaagctagctgcaccacaaatattattccatttttcttgcctgtgagtttaacctcatccttggcatatgacagatgctcagtaaatgttttctacattggattaaggttgttgaattgaaaacatagcaaggcgaggatgagagtttcttccctgtctaaatcactcagccccattttaaagaaaaactctgtttcgtggtcacaaattctaataccaacctgtttttgttttttttttcctcacaattgtgtgttattggccctgggtaaaccacatatgtcatacatgtgtgtgagaatggcccagggcaaacccaccagtgccaccttgggacaaggcaaattaggatttatatgatcaatacttaggtcactattggtagccagcatgttgcatttctttttttttttttttttttgagatggagtctcactctgtcccccaagctagagtgcagtggcgccatctcagctcactgcaagctcctcttcccaggttcacaccattctcctccctcagcctcccaagtacatgggactacaggagcccgccaccacgcccggctaattgtatttttagtagagatggggtttcactgtgttagccaggatggtctccatctcctgacctcgtgatcctcccactttggcctcacaaagtgctgggattacaggtgtgagccaccatgcctggcctgtatctcttattgtcagtggatttatatcaacatcctcacagagactcctgagaaggcagtttgaccaacattattgcatttgttgcaaagagaaataaagccagaaataaaaaatagcgaagaggatgttcccaaacaaaatgctcctctgtgaaataatgtggctgatacgaactgcatgcagtatgatagcaaaaatgtggctgataggaactgtgtggagtatgattgcaataatgtggttgataggagctgtgtggagtttgattgcaataatgtggctgataagaactgttaggagtatgattgcaataatgtggctgataggaactttatgggatatgactgcaataatgtggctgataggaactgtgtgggtatgattgcaataatgtggctgataggaaccgtatggggtatgattgcaataatgtggctgataggaactctctagggtatgattgcaataatgtggctaataggaactctctggggtatgattgcaataatgtggctgatacaaaatgtatggggtatgattgcaataatgtggctgataggaactctctggggtatgattgcaataatgtggctgataggaaccgtatggggtatgattgcaataatgtggctgataggaactgtgtggggtacgattgcaataatgtggctgataggaactgtgtggagtatgattgcaataatgtggctgatgggaactgtgtggagtatgattgcaataatgtggctgatgggaactgtgtggagtatgattgcaataatgtggctgatgggaactgtgtggagtatgattgcgtgatgcacttgctttgttgaaagtccagcctgttgtcgaaatgctatctagtgatgtttttatcttttttctctctctcttactaaaacctccagagccactgaaagccaccatcagtcccaggaaggttaaaagcagcgtgggtagccaagtttccttgtcctgcagcgtgacaggaactgaggaccaggaactctcctggtaccgcaatggtgaaatcctcaaccctggaaaaaatgtgaggatcacagggatcaaccacgaaaaccttataatggatcacatggtcaaaagtgacgggggcgcataccagtgctttgtgcgcaaggacaagctgtccgctcaagactatgtgcaggtggtccttgaaggtcagtgggcctcgtttcagggtatggctgaaaaagaacccaaacccagagcactcagaaaagaagaagacagggtgaagcagtgctgatcgctcagttctaggctctctgtctcaccagctagtactctaccctaatttttcaagctaaatcaggcaaatgggagagaaagttctgacgaaaataaaattgtttcatattagaagtaatgtaaagtaacataaatgttgcccacttgtgcattagaagttatctgccagggtttaaatcttagaagaaacttgacacttaacagttttgttgattattcatctctagaccagggtctttcaagaatgccttgcttggggaatttttttttttttttttttgagatggagtttcacacttgctgcccaggctggagtgcagtggcacagtctcagctcatcacaacctctgcctcccgggttcaagcaattctcctgcctcagcctcccgagtagctgggattacaggcatgcaccaccacacctggctaattttgtatttttagtagagatggggtttctccatgttggtcaggctggtctccaatttctgaccaggtgatctgcccgcctcggccccccaaagtgctgggattacaggcatcttgggaaacttttttatgtgttataggatctttggcagcatctctggcccctttccactagatgtatgctaggagcaccttcctccaagttgttacaaccaaaaatgtctccagacattgccaggtgtttgctgggtggggtgggggcaatagcctccagtggagaagtacaacttcagattgaaaatgcagagcaaaatgtcagtacagtggttggtagaatgaaaatatggcatctgtttggtgcagttgtccctagttccatccaaatgttctcagatttaagtaaatgaaatttgtgaggaattattttgtggtataataacaggttttggatatgtgatacgatttgcttttttttaactggttactgcatactaaatcttaaagcttatcagtcagccagagaaagaagctatcacaggcaacatatatttatcactacctgattgaactagcttctatctatgtatttgtgtgtcttgttggaaattatgtccatatataatttaaaattcatctgatatcaattgattaaaataataaaatgattttgatatagcctaaagggagtacaaagaaaacacactaatatgtgaaagtaagtttaaatatatcttgattataagaccatatttctgtcattcttttttaaccttagctaattttttaagaagtagcaggtttagcaatgagattcctattttgattcaatcgtttcattgcagacagtgagatttttaaagcagaggtgaaattagctgaaggcatggtattcatattaaatgcctgacactgtgttccgtataataattaagtgcagaaagtaatcaatttgtgcagaaccagtttgctaatgatgatgcactctagtccttacatagtcactatttttagattctttgtagaaaaaggagaaattacctgtctaggcccagttaccccggcaaccatttggtgcaactaagaaaacctaaagaccatattgatgatccataacgatgtcagaagagttcaggttatcagagtgacagcaagaaagatttcaaagacactcaggtctccctgggaaaataatgtctgctttcatctccaaaagagcctgtcacttgaactaaaaagggggccgaggcgcaccgccagcacactcgcagatttatttgtcgcatgtcagcttccattcaggacaagaagcttcacttttttttttctctcttctgagagatgacagtgctaatgtagcaaagaaagcagaaatggaattacaaatacatatctagtacctgctttaaaagagtgtctggctaatttcctctggaaaacaaaaacactcccattattctcactgaaatagcgatggattaaagtaaaattataaaaatttgcaatactgtgaactaggactgaggatagatacaatggagaatctgagaatatttcctatgaggctataaaatggaatttaataattataagttcaggataaaaccataatacctgaaaaatggaatgattttaaaaaagaataataaaagtttccagttctgggaatggtaaaatagcatatatcagcctaactcccaagatgataaaaacaagaaactttgggaaaagcaaaagtatatatagacatttgagagacaccaaaatcaagttggggagtgtcctcttccactgaggacacatctgaactccaaaaatggggagtgagaatacaaatgtgcaataaaaatgagacatacaaaaaacaggactctgcacccaaaggacaaaagacaaagcaaacgatagaaacaaatcatgagaggacccagatgttagaactggcaaacaaggactttacagatgctatttaaaatatgttcaataacttacaggaaaatatggactgaaagagtgaacgtatgggaaagaccaacagagaaattgaaactgtagaaaacagtctgtagaaatgaaaaaaaatcaccatatttgtttaatacaagattagagaaggaagaagaaagtatcagtgaacttgaagataaatcttagaaaattattcaatctgaagcatggagagaaagaagactgcaaagaaaatgattagagcttcagtgacaagtaggacatcatcagataacgtgacacacacatatgactagaggcccagaaaaataggagatacggaatgcagaagaaaaaagtattcagagataatgaccttagttttatcgactttggtataaaagtaaggttgcagatctaagaaactcagcaaactccaaaaataaacacaaagaaaattctatgtcagtacatcagagttaagctgctgaaaaccgaagataaagagaaaaacttaaaaatctgagggaggaaaaatattacataatgaggacatcaataacaaatggtagatgattcatcggatattttggaggacaggagacaatggagcaacatctttaaaatgttgaaaagaaaacgaaaaacaaagacacagccctgccaacgcagacttctgtagcaaaaaacccaacaacaacaggctttaaaaattaaggaaaaataaagatattttcagtaataaagaggtgaaagaatataatgtcagcagccctgcacattaataaatgataaatgaagtcatgccggatatagagaatggacatttatatctacaggatatagataacatggaacagaaatggaacataaaatggagacatatctataagaacaaataccatgagaaatggtaaatatattagtaaatatttagcaaaattgtgttttcttttttaatttctttaaacaattgatgattataacattataaaattaccacacttggccatgtgctgtcgctcacgcctgtaatcccagcattttaggaagccgagacaggcggctcactcgaggtcaggagtttgagaccagcctggccaacatggcaaaatcctgtctctgctaaaaatacaaaaactagccaggtgtggtggcatgtgcctgtaatcccagctacaggcagaggcaggagaacagcttgaacccaggaggtggaggttgcagtgagccgagatcctgctactgcactccagcctgggtgacagagtgagactccatctctaaaaataaaataaaataaaataaataaaatgaaataaaataataaaataaaaaataaaataaaatgaaataaaataataataaataaaataaagtaaaataaaataacactttattatagagtaaatataatagatgtaataacacaaagggcagaattatttgttgcagggttcttacatttcacataaagtactgcaatcttaacttttagcagagataatttaaaacatatacacacacattgatatacatatagattgtgtgtgtgtgtgtgtaaatcaattggagcttatcttataatgcaagattggaagaacattaaaaatctaatccgtgtaagtcactatgttaatagaataagggagcaaatccaattgattatctcaatatatacagaaaaaatcatttgatgaaacttgcatccattcagcataaagaatttctagcaaactgagactctagagagcttccttgacctaatgagtggcatcctgaacaatctacagctaaaatcatacttcctggttaaacactaaatgtttttcatttaagattgagaccaaatcaaggatgcccacatccaccacttccattcaacattatactagcagccctagttaggcttgagtagaaataaaatggatggagtttggaaaggaaaaatttcagctgtcttaattacaggcattgttgtttacaaagaatatgccaagaaaacaataaagcaatttctaaaagagagtttaaaaagtcattggatataagaatgatacacaaaatgcaattttatttctatatactcagaacaaacaattggaaactaatattttgaaactttcatttacaataacataaaacataagataggaatatattttaaacaaacgtgaaagatttcaacatacaaaaatacaaaactctgctaatataaaattgaaataacctaaaaaattgaaaagatataccatattcaaggattagaaaactaaatattcctaagttaacaattctctctaaaacgattaatgtgatttcaagcaaaactgaggcatggtggcttgtgcctgtaatcctagccctttgggaggctgaggcccttagcccaggagtttgaggccagcctgggaaacatggcaaaactttgtctctacaaaaaaaaaaaaaaaaaaaaaaggcgtggtgtgcacctgcagtcccagctacttgggagattgtgccacaccaaggacaacagagggagagagacactgtctcaaaaaaaaaaaaaaaatatatatatatatatatatatacacacacacacacacatatacacatactatatgtaccttttcaacaaattaacactgaaacaactcaataaatgtatggcaaaaaaatgagtattaatccctacatcacacttcatatccacacaaaattaagttgctatccgtatagaattgaatataaagtataaagcaacacagtctccaaaagaaaacagaataattcttcatgatttgcgaataggtgacgatttcttaggacacagaaagcattaaatgtcaacacaaatacattattaagaaaagaaaaaggcaaccacagactgggataaaatattttatacacacacaaatatatgtgtcatatatatgttgacagatattatatataatctctataggaatcttacaaatgtatcagatcattataagatatctgacatagatactatatatatatttccttgtatttcaattgttgtattccacaacaaatcaaaaacaaaaaggcaaacagtctaatataacaatggccaaagatttgagcagacacccactaaaggaaacacacggatggccaataggcacataaaacacgtgccttccacggtatttctgggaaaaatatacaacctgcgtttagtcatgaggaaatatgagacaaacccaatttcagcaactgactacaaaattactcttcaaaaatgtaaaagtcaagaaacacaaaagaggctgaagaatgttccagatgaaaagaggctgaaatgacatgaaacataaataatgggtgatacggactgctctggaaaaaaaacagtgacgagggatattagcggtcaatggacagaattttgctgtggacagtgagttagataatagtactgttccaaagttacatcttctaattatattctaagtgtactctgattatgatgatatatatgcacatataaagcgtgcatactctattattatgtttcttctaagctcaagcacaggcaaaaccagcacatcctaagaggaatcagagcagtgatctctgttggatgtggatttattgaaaggagcacttaaggaattttggtaatggaaatgttttatatcttgatcgtttttgtggttactctggtgtgtatatatttagcaaaactaagctgtacacttaagatctgtatatttcactgtatgtaaaatttacctacaaaaagagaagtataactgaagaacatttttctaaacacttgagttttcagagcttaatgtaaaaaccagtgaaaagaaatctacagctaaacacattttacaaaaaccatggaattataaaggacacgtgaaataactccagtactcctaagtattaatgactgatcatggacaatgaatagcaatcatgatgacatctaacttctctgtaaaattaaacacaggatgtgatgaggcaacgtctgcagtgcgttaaagacaaaagcatcaatttttcattttaatattttaaagttgtctttttcatctctgatagtaagagacaaaatgcttacaacccaaggacactgcaatatgctacttatgagcatagcctggaggaaacaaactccagggacttctccagccacctgaaacatgagctggaatgaagaagtgagattcaggaatttggaaaggagtagggggtggagggaagagctgcagcacagccccatcaccatgaagaccctacataactggcctccctgaccaagaactaggccccaaggttctgggggaatgagtggcactttcctcaaaggtgtctggtactattaaccattaactgtcacctttccctgatggaattgcaagctatcctaattttgcttgcctcctttctttttgtttataatactttccaattttcaacaaaaaagatattcaacaatggagattcattacttttataataaaatcaaaaactaaaaaaaatctactcattcttatctttcattatgggacaaccctttaattgaacacaaaaattcttttaaaaaacaaaagatgtcccctccagcaaggtctcttaccagactcagaaatcctgtggcatgtgattgcaattatgtcaaaatgacccacttatgcctagaaaaaatgtgtcacagtgttgatttgtatgcctgaggctggctgacctattggtaacttttcttctgattttcatacatttcctttaatatgcatgtatttctttttataaatggaaaaacatatataaaagaaacatgcatttgtaactattactatataagagaaaaaaccatatggatgatagaaaaataatggaatatgaaaatttgatctatgtaaacatactgaaaatttctatggagacttctctaagattaagatcctagtttgcctgcgatagttctgggtcatgcctgttctcttggcataattattagtcctttctgtttcagcctcaaaagtgtcccaggttggatgttaaattatatggccagcctacttaagatacttttagagagatttaaaacatgcttaagtaccctacttaagatatctttagaggtttttaatacacggcatttaatacaaactttatttagcttctacccattctcagagacttcatggaagtttgcatgcaattactatttgtaattaaagttattaaaagaggatttcttatgagaaaatgatgaagatgaggtcatcaatctctcagtagtttcctttattcctgtaaagaattccctagtgagaaaaccccaaataacttgaggaagtattaggttggtgcaaaagtaattgctgtttttgccattactttttgcaatcacttttgcaccaacctaacagataaagtgactgtttgtgggagtgagcgggtgtggattttccgtctgtttataactttgtgtgaggaaacaccagttttaaattaaggacttcttaggagctgtcattgtttaacctgaacatctgagttgtattaccattcctcttaagtcaatcaggaaatatagaaacagttgatgaaagcttgctaacactgtgcttacctgttttgaaaacagtgaactcttgttctgattaacgttttgctttatcaggaaaaccagacctttttggtaatgtttaacaactacgacatttaccccctagacatgaaagacatatacttggaagttgtttaattatttgtatgtgccactttcttccataatttgttttcctgcagatggaactcccaaaattatttctgcctttagtgaaaaggtggtgagtccagcagagccggtttcccttatgtgcaacgtgaagggaacacctttgcccacgatcacgtggaccctggacgatgacccgattctcaagggtggcagtcaccgcatcagccagatgatcacgtcggaggggaacgtggtcagctacctgaacatctccagctcccaggtccgggacgggggagtctaccgctgcactgccaacaactcggcgggagtcgtcctgtaccaggctcgaataaacgtaagaggtgcttgtcaaatcagctcctcaaaaaaacacacataactcattatagtggagaagaagatttctgcatgcaccgagctgggtcttggaatgccagagcggattaactgttgcttcccatttcctaccctctccttcctactcaggaatggcactgactgggttaatgttggaaatggcattttggtttctgtagtcagcttgttcttttttactctagatctgttcacctgatgtttcctttcctggtttatgctctgcatgccctttcccttctccttctcttcggttcttccacattcatggtaaaccttcatgtacatggtattaaacttacattcatgctgcaacgtgatgtaacctccattgtcgtcctagattttacagagagagttaaacaattgatcaattgctgccagtgtgttcaccaaaagtgcgtgattgtccagtatagactagttactttctattaattaaattgccttttatcttgtaatttttaattcaaaacattttcatagaagtagcagataaagtgtttcacagttatacatttgaatttaagaaaaggaaagaaaaacctttgttgtagaaaatgccacatgcaaaaatatttgtttaactgaaaaagatgtgcttacatgaatataatctacatttttaactcaaggaaaagtgtacccatttccctacatgagatgtacccttaaattattttcaagagtttctttgtgtctctccagggcctgcaagcattcgaccaatgaaaaacatcacagcaatagcaggacgggacacatacattcactgtcgtgtgattggctatccgtattactccattaaatggtacaagaactctaacctgcttcctttcaaccaccgccaagtggcatttgagaacaatggaactcttaaactttcagatgtgcaaaaggaagtggacgagggggagtacacgtgcaacgtgttggttcaaccacaactctccaccagccagagcgtccacgtgaccgtgaaaggtaagccctgttctcctggttcccacacaactcattccatagcccgactacttcccagaccaatgatttgaagtcgggtaatccaagatctgcttatttagagcaggataattgtacaggctgaagaatgacagggaacatgagatgtcctctttactactgactgaatcttcacaggaactttagttgatctgattttctctccaggtggaattttggcttggttttccagagggcatgtgttgttaacaatacaacagaaaaaaaaggagcacatcattagcttcattatctagtcatctctcagataatttttaaataaataaccttcttttcctaaaacctcctaaaagcaaggtctcttagaacttcactggaagggattttctgtattggatgaggatttcaaacaaacgtcttatcttctgtagatgagcaggtcaaagcaacaacatagaaattatatgtttaaaggatgccacagaacgttttcctcattaaattattctttgcatcatgacatggactgtcatggaatctacctgtcaggatgatctttagagatcctgcaatttgaattgactacaatctccttaccagaaaaaaacaataaggtgatcagactcatccaaggatacgcagacttttagtggcagagcctcagaaagactcatttcttctattctacaagtcagtttcctgagctgaatatgaaataaaattgttttaattatgtaaggaatctacctgaggtgggtcctaggaatagaactaatatgttataaaactatttccgaaacctgtgggtgttgcttctagccacattgagctgcctgtctgaggtgtccaagttctctctccaggaaccaataagtggcttttagttgcccttgttacaaagttgcataggtttcctgtggtcttccccaagcttcttttcccaccaaccctgtgagttttacttttgtgagaacgcatacagacacacacacatggaaataataatatgtgtatactattattacggggcatatatattgcattacattatatattatagaatatgtattgtgcattgtatattagatatgcctgcacataattataaatcggtttttaataaccatatgtcttgagaatttcctcaaatcactagatattcttggtaaaccaggctgcataaaggttcatttggtggttgtgtttatttatttaatcctcatttacagaacatctgcttcatgccaggcactactctagacactgaggaatacaacaatgaaaaaggtctgcaaggtcctttccttcattgactctcttctcagtcaggagagacaaacaataaacaaataaaacaagtgaataaaccagaaaacacctaatggtactccatactatgcagagaattaaaacatggcagtatcttaatggttcattgcaatagtcagatgccatatcaacacattttctgtactctgtcatcttaaaattcattggtctatcatacccttggaaggaatgttttacccacacatgattttgtaacataaaaagttgatcatttggaaatgattggttcactgtgttacacagatcttccaaatgttgatacaatttgttatacaatatcaaaatatcacaactactaacattaccatgatctcatcagaaagtcttcaagtaaactgtcaagttcatgctgatggatgcaagttttctaaaattctattctttcttgaaagattcaattttattatttataataaacaccatcaattgtaattgtaggagtgatgggctcatttatctgtaagaaattgtttgacaaatagaaaagaccgcataaccatcgtttttaggtagccattcttttaagaaagaaatggaattccatgaagaaaagcagctggtcgaatttgcaactcaagcaagcacagacatactctgcttgaaaatagccgtgctgctcaggaggtggaggaaacactgtgccttcttcccattttattacacaggacatagaacattaaaaataacgtgagctttagggtaaagatgtaataaaactgttatgtttcctgcttcgtcaagtgtctgtaagtgaatctggcatttttaaaaaaccaactcacagtatgcatcggtaaacagtacaatgaatagtcatcctgttagtgtccctgctgggattcatggtaacgcccagcagtctcacccaccatggcttttgctccaacagtgcaaatgtcaacaccatgagaaaggcaaacagcacctcagcattgtcatgaaaacgattttcttcttacagatcacctaaaattgtctcagggatccctacaggtctgtgagctacattttgaaaacatctaatacagtgctaaaattttagtttatttttaatgtttgaccattacaaatgaggcatcaaatgaacttctttatgcattggcctttgtctgattttaagattatttctttcgagaaaaatttccagaagtatgaccattggataaataggtataatactttaatgtaatttttaggagacatagatttaaacgaaagccctttgaatcattaacatttattctttaaatttgccagatcagtataaatgaatgtattcatcttaatccttttgaagtgacagaaaccaactcaaactagcttatggccaaaagaataatttattgtctcttataaacaatatatttatgattttaggaaataattctattgaataattttttcttcaggagcttcttttcttctgaatacttatcatatagtataaaacttgtcagctcctttgcaagtacttgcaaacaaaagaaggaaaatattattttatgtggtattttattgcctggagagaaatggcagttgttgggatttggggcttgccaaatttttcagaatagtcgggaaaagctgcctggaaaaagtgagattttgagcaaagatgtgaaggggttcaagacagctcatggatacctggggaagggacatcctaggtaaagggaagagatacaaccacggtgtctagagtttgcctggcaagcttgaggaataacagagaggctggtgtggtgggagccaagtgaacaagaaaacactaaaaggccctgagtcagaaggagcagaaccttttcacgggggacttactagatcaggacttcggttttcaggacgtggggttttctgctgagtgagatgggggctttattggatgactttaaacagaaaagtcacatggccagactaaggttttaaaaggatgcttttagccaggcaaggtgggacgagcccgtagtcccagatactccagaggctgagacaggagaatacttccagtctagtagtttgaggttgtggttgtggtgcactatatttgcacctgtgaatagacactgcactccagcctgggcaacatagtgagaccccatctctaaaaagaagaaggacgcatctgattcctgtgctgagaatggtctattcggggaaagggggcaagtagaatgacctgttggaaagtgaatccaggtgagagatgatggtggcttggaccagggggagagcagaggaggttgggggtagaagacagactccggatctatttcgaaggtctattcagtcggttttcctagtggttggatacaggtgtgaggaaaataaagacatcaaggatcaggtcaggcttctggcctgaatatcaggaagaatggcattgctttctactgagtcagcagaagatgcagtggagccgtttgaggaaggcgattaggagtctagttatcgatgtgttgaggttgaaatacacactaaacaaagaagtggatgctgtcagtaggaaattagatatgggagagtagagttcaggaatccaggctgcagatctggtgacatcagtgaatagatgatgttcaacaccaaggcctgaacaggaccctcaggggactttgtgcactacaccgcagattttaacttcatatgtacaggcttccccagcccccagtcaggctcacattagaacccttcaccaaatatctgaaaataaagtctgacaaaaattcaaacaaggactgtttgaaatgtaagtttacctatttttagatttcccagattggcacagatccatgtattgactatgaccccattggttgcaaggtgcgagaacccaaattacctttgcttaagcagccaggtgcagaggctcactgctgtaatcccagctacttgggaggcctaggtgtgatgtggtacgcacctgtagctccagctactccggagactcaggcagaagaatggcttgaggccaggagtgcaagactgtggtgaactacttccaaaacacagtaacagttttacaccattcgcaatcttagcctttactcagaacttagaagggtcttaaataaaatgacttctgaacatttaagtttacattttaaaatattttaacctcagcactttgggagaccgaggcaggaggatcacttgaggccaggagtttgagatcagcctggccaacgtggcaaaacctggtctctactaaaaatacaaaaattagccaggcatggtggcacacacctgtaatcctagatactcaggtggctgaggagggaggatggcttgaacccaggaggcggagtttgcagtgagccaagatagcaccactgcactccatcctgggtgacagggaagactctgtctcaatcaatcaatcgatcgatcagtaaaatgtttttaaatgaaatattaatatataaagtaaattatactccaatggtcaggattgtagtttatcaaggctttttaaaaattaacctttactattttcagttaccaagtattaggggagggagataagaaattagctaaattttaggaaaagacttagaattttggctttccctgtggattaggattgaaagagactttcttattttgttcatgtaaatgcagctccactacttttcctgggagaccacacagtgaatatttcagccagctaattttggaagagcaaacctgaagccttaaaaattggcttccttgggaagtggaagtggcccacttgatcccggcaataatgctgctaacagggaaaccaaattattgttatcttgtccccaggaggttcgttttaaatactggatatagcggaaagtgtgtgcatatgtgtttagatgatatttggaaacaatactattttttcatcatgtcttttcctggcaatagtcataaccctttgcttattttggagcatatgcctgcaattttttttatttcaaagattgatataaataatatgcttattattgatggtggttgaagcttaagcagttctgaaatatatgtaactatccagaagtgcaagtttgctgccttcaaacatataggcagaagtaaaagtcaaagtcccttctttcacttcatttcaacttaacaagcagttttatatttaacacattttcaagctttgtctttcccattttaggtgccacattgaacttgaacggtgcttaattgcgtgttctaattgctggggatcaacactgccaggaaagttaattggctgctggataaaaatgtcaccttttatttatatttatataaaactttatagtttacaaaacactttcatctgtgtcaccttaattaatacagtgactctgtaacgtagataaagcataatcagggaaagaatagaagagagatgaggctgcgcacagtcacccagtaatacattcaagactcaaacgcagatgttttgattccaacacaacccgtggtgactctcagaagaataattcgtattgcagcgggaagccagggtaggagtggggagaaatgaatacaaagaacccaggaataaagctatttaaaaagtcaagacagacaacatgttaaaatgtagggcaaaagatattgagggactaatttaagagagatagcatttgttaaattggagagaggaaaaggagagaatggatttggtgaaagagggcaggtcagaacaagaaaggactccagaagctcttgcttgggagatggagaggctgagaggagcgatgtggcacctgagtgtcttggcgaaagcctttggatggcggggttggtcttaagtgcctgtggatcaccattctggcttcagaccatggggatttaaaaaaatagacaggaaagcaaactaaaattcatagagaagggtagttaaaatcacaggtaaataaatgtctaagaagcaccaagctttcagagtcatattttatgaggatttttaaaagtgaatgtttgccaatagtgagatgaaatggccatgctaggaatgcagagaacaacagaaacattcgcttttacatatttcattccatttctatatttgtggcgatttctcattttaatgtaccagcatttttttaccatgtcctccttcaaattgaagggagaattagatgtcactgccagggttttcagctcttgtgttggtggtactttgtgtactgtagcccaacagggacactgttctgcacattttgacgttaaaatcctgcttccctgcagctttttgtcctgtgctgtgtctcgtctgtcaccgtaatgtcttgctgtattgctgttggtgcaagtggggaaatgaatgctgagttaaaaataatgctgtgagtgtgtctgctcgccttccactcgaggtgagcggccggggatgccgtcttctaatgacatcattcttcaaaggctgggaacaaatgtcatctcgcctaggtggagggacagctttgtgcacagaaacagccttggcagtttccccactcctgctttcagacatttgctcattagctgttccaaccttggcactatcagcttccactgaattccaaacccaactctgttggcaaggaaaggtctttcattcttaatctgtcactttcttccactttctcctactatctctctagatactggagttacttgcaatattgtttatggaaaggacagcattttgagtttatttttccattttagttcctcattaaagtggagcaatggttaacttaagctccagtttgctggggtcttttgtgtgtggccatacactgcagtcatccacatattttcatatttatttttcaacaacgacttgggaattgcagagcttctattatgaataatacacgagaaatatagacctggggaaaaatagaatggtaacgtattaaatgtataatccttttatgttaatttattatttaaaatgagaatttatactctctttttaatttaataccctaatgtgagaaaagaaagctaatgaagtgggaactttcactgtcctccctttttaaatgacgcaagaaagcactcatgcttcaatatacttaaatggatgcattggctcagctaccctgggggtttatgctctcaagtgtctgcagaagagaggtaggatatcaaaattgagtgcaggactcagcttctatgggttccttcagacaggtttgtcctggaggtggaatgacttaaaattcctctattctagaaatcgaagcagacacctttctttaaaatatggcattttattaagtgttttataagcgatatctcaaattactttaccctaattggagggaaaaaaagactatgtgtaagattggtttcattatgaaagaatgctatatatatatatatgtataatatatatttattatataatacatatataaatatatgcataatttattatatataaatatatgcatataatataataaatatataatttattatatataaatatatgcatataatataataaatatattttgatatatataaatatatgcataaatatatgttatgtattgcatatattacattacatattgattttaaatgtatatacatgattttttacattgtaaataaaataatatgtatttacattttaaataaagtgatacgtatttcctgtgtatagtataatgttttgaaatatatatccattgtggaatgactaaatctgatcaaataacatataggttgtctcacatagttatcatgtttgtggtaagaacactttacattcactgtaaacatttttcaagaatacaataaattattagctacagtcaccatgttgtacaatagatctcttggacttttcctcctgaaattttgtgtcctttgacacacacctccccagtaactccagcccttgggaaccaccattctcctttctacttctataagatcaacctttttagattgcatatatgagttagatgatgtggtatttgcctttatgtgcctggcttatttcacttaatataatgttctccaggttcatccatattgtcacaaaggactacagctcactctttcttaaggttgaatagtcttaaggctgaaggtccttattttattttttatttttattatttatttatttatttatttatttatttatttatttatttatttagagacggagtctcactctgtggccaggctggagtgcagtggcgcgatctcggctcactgcatcctctgcctcctgggttcaagtgattctcctgcctcagcctcccaagtagctgggactacaggcgtgcaccactatgcccagctaatttttgtatttttagtggagacaagccttcgccatattgaccaggatggtctcaatctcttgacctcgtgatctgcctgcctcggcctcccaaagtgcagggattacagttgttttattttaacttgtccctttttttggcaaccattgtgtatgtataccatatattttttaatccattcatctgctggtgaccatttagccacttgaatccatatcttggctattgtaaacaatgccacaatgaacatggaagtgtagatatctcttcaacacactgatttcatatccttttcatgtatacccagtaatgggattgctagaaaatatggtggttctatttttaatgttttgaggaacctccatactattttctatagtgagtataataacttgcattcctatcaatacagtacaaagcttctcttttctccacatgttcaccgatgcttgtttttttcatgttttttataatagccattctaacatgtgtgagatgataacctcattttggttttagtttgcatttccctgataattagcgatgttgagcattttttatatacctgttagccatgtatgtcttcttttgagaaatgtttattcaggttcattgcccattttttaatattcattcaatttgcctattttcaaatcaggttgttttcttgctattgcattgtttgaatcctttatatattttggatagtaaccttttatcagatgtacggtttgcaaatatattctttccttctatatataggttgtcacttcattcactctggtgattgattcctttgctgtgcagaagtttttttagtttgatgtaatcccattgttctatttttgcgtttgttgtccatgcttttggggtaataaccaaaagtcactgcccagagcaatgttaggagatttttccctatgttttctcctagtagtgtcatagtttaggcccttccatttaagtcttaaatccagtttgagtttaattgtgtatatggcattagagacatcataaattaaagttaatgatctaattccatttttctgcttgtgggtatctagtttccccaacaccatttactgaaaagaccccattgtgtgctcttggctcctttgttaaaaatcagtttgctgtaaatgtgtggatttaccattctggtccattggtctatgattttatggaagtacaatgctgtttggttattatagctcagtagtatattttgaagtcatgtggtgtgatgcctctagctttgttctttttcctcaagattgttttggctattctggctcttttttggttatattggaattttaggatttttttttctatttctgtgaaaaatgtcattggtattttggtagaaagtacattgactctgtaggtcacttcaggtaagatgggcattttaacaacatgaattcttctcatccatgaacacaagttatgtttccatttatttctgtctttctcaacttctttcaccaatgttttatacttatcactgtagagatctttcacctccttggttaatttattcataagtattttagtttttgtagctattgtaaatgagattgttttctttaatttttttcagatagttcactattagtgtatacaaacactactgatttttgccttgtagctttatcatatgattatttcaataggtgtagaaaaatacttgacaaaatttaacatcctttcatgataaatattctcaacaatttagatacagaaggaatgttcctcaacataataaaggccatacatgacaaacctacagctaacattgtactcgagacaagttggaagcttttccttaagattctgaacaaaaaaaaaaagatgcacactcttgccacttccattcaacatgtcactggaagtctcagccaaagcaattaggcaagagaaagaaatacaaggcattcagataattcaaattggaaaggaagaaattaacttgtttgcaaatgacatgaccatatatatagaaaaccctaagacactaccaaaaaggattagaagtaataaaccaattcagtaaagttgcaggatacaaaatcaacatataagaatacaattcttttatttagttaaaattgcaagataaattatgttttataatacttgttgcacttgctgaacatgggaaacttagagaaggagagaattatgtagagataagaaagggaaaagaatgccaagcaaattactaacacttttgctgtctaattcataattaatctgcaaatacacacacgtttgtgcacacaccacagggaaaaactctttggcagtgctaaaaataatgccgtgataatgacattttaagtcagaaataacaactctcaattattcagaaccatgcggtaggatcttttatatgcattgactcaaaacacatgtaaattgtttaaatatataaattcaataaaattgtgtacttcatacacctatataacatttatatgcattatattttaaatataaagatatataaatataaaacacaaatataaatatacatatagttatatatgtatattatatataagtacatatatatgtggttacagatatatagatgcatgatacaattatagactcttagaatcttagggctataaatcagcttgaagttcatctagaccagcctcccatgtgatattcaacatgcccctggactgtaccccacatttttctagactcttcctgcacgatctgtgcagtggttcactaagctctcagccctttctgtttctacatggctgtgattgtcagacagttcttcctctgtctgacatacatacaaatagagatacatacaaatatgccttctctagctcttctcttctttctggttcgaatattccctctagagcaacactaaatagttccccgtttctccacataaagctcccagtcgtgcaaaagactaagctttgtcttcctggctaaccatctctagcgtccccatttgtttaaatactttgtatgcaacgaagttcagcagctcctttcctttgaaggacacactgatgtgtctattttgtctcaatgaaacatagccctctgggcattttctaatgaataaaagaggggaatgagagtgccacctctgtcctgaagacaagaacgcctagttgcagcccatgtcccactgttgagccatggtttgggactcatgaacaaaaatcccaatggtgaattttgtttttgttttgtcaacttttggctgacaccacaccattatcatctgtccatgcaagatccttattttgttttattttaacttgtccccccttttttcaaccatccaccaattctggtatcgtttgtccctgtctcataggcacagacttatgtgtacttaatatatttattttaaattaattttctggcatccttatttagacatgcatgtaaatatatacaataacagcacaaaagtgaatgcttagtttgccccccacccagccctttgactctgtacaaatactaccatgggtatcttataaatgtgtccatgtgtagtattaatattactagagggccagtagtagaattgttaggtcatagaatttaacttcactaataattgcatagccactctccaaaattcctataccagtttactttaccaccagctatgcattagaggtcccagttccccgcatcctggtacctgtgtttctatttgtgacaaagctgattgatgtaaaggagctctttgttttaatttgttttcttttcattactattgtgcttgaatgtctttttatactctcaggagatgtctgaggatttcatctatgcattgctttgtgcatttgctatcactcctgctacttcttcctgctttgctgtagttctttagtataaatatgaatctcttattacttagaaatgattgtgaatatcttttccaaggctgtcttttctctcttaactttgcctttgtcttcatttggaccttgtttaagaaatttatgagctcatgaagatgcattcctatttttttctgtatttgttctatgtctctatttttgctgtttgcatttaggccttcaacccacactgagcttcacagatatagtaaagctggggtccaatatattttctatctatatcgagtcagttatcccaatatttattaaatgacccatgttttcttctcctctccatctaccaagataccatgatggtgctgtcagaggcagtcttagttctgtgaaatatattgactacctttttatacccttgtctcactgtaacatatttcagcactttacttaaaaaaaagcctcttcaagtcagttattattaaccaagcttctaaagagctatgaccttttctaagccaacgtcatgaaaaatacttctcaagcaaataatctattactaacaatccttgtaaaaaaactaattggaaaaataagccaagttttaaaatgaataccagtgattttatgaatcttgtttacttttgttattaagcctggttgtcgtcacctctggttggggtcacatggctttgcttccatcagaagtccatataaacaaaaataaaataattgtacctcatctagatgacacttttctctaactaaataagtaaaacatgagatatgtttcattttcttgatgccttgatgattcaaatggcttttcttttcatattaaaaatgcagaaaagtaactcagttttattacagtcttctgtatgaaggtattattgctctcaaccaggggaaacataacctgtcatcctgctcagaccatggtgactctaattgtttacatatagatattatcataagtttttaagttcttggtcgttttaatcttttaaagaaactatttcaacataatatgattatggctttacaatacactccataaaaataactttcaagagatgtttcatatgattgaagactcaaatggccccaagaaattatccagttctttccaccacattcccctttaggcatctggttgacaatattgcagggcatccattttttttggaagtgcattggaaggagacactgccatgcttctcagagtttgttttactcttttacgcccccaaatttcaagtagtttattttttccctttattgtatccaacttgcatcttttgtgtttctctttattataattctactttatgccttgggatatctttttcttgttcctaaaacattttaattatttttttcctcccatggacttacttgataattttaaacaatttttgggaaaaaagttatttgccttccttttatttccttttctctctctctcttttttttttcttttttttttttttttttttttttttttgagacagagtttcactcttgttgcccaggctggagtgtaatggcacaatatcggctcactgcaatctctgcttcctgggttcaagcaattctctacctcagcctcccaagtaactgggattacaggggtgagccaccatgcccagctaatttttgtatttttagcagagatggggtttcactatgttggccaggctggcctcaaactcctgacctcagatgatccgcccacctcagcctcccaaagtgctgggattacaggcgtgagccactgcacccagcccccttacttcgttgttatatttatgactctttacctcttttcacagtctagcagtctaaaataagcatcctatagaagaactactttgtttaaaatcattgtagaaaagttagctactcttattcctgatatattccaattattagagagaaaaactgaatttttgctcagaacactagctaaacttgggccagctgaatgagcaaaaacaacaaaacaaacacagcattttttttaagttagtgagcaacaattttaaaattcaccttttaaacgttttcccttgcttctttttttattcttcttctatcttttccttgttctgagggaaaataacaagatacttttcatcatgtatagaggggtatatttgaaagagaactcagcactaattctcttctagtcccagtcccagatgagttaaagtaatgtgaatggatggttgaagtatatggagagtgtgtcacacacagacctggttttgttattaatggtgcatgcatttttgctgtagatgaaacaaaccattgtggttgggtttttcgggaagctgactctgagatggatgctagtgtgaagagtgtttatcaaggagtgccttatgatcaacaaccgaggagggaaggacaggaagaaggactgggcgaagaaagagtgagctgggatgcaggccaatgacagtgagctctggagcaagaacagtccttcagggttgtcctgagtttgggcagaattgctcctcaatcagtcactagattgaggacactccaaaaaagagcctgtccttgggtgaagtgggcctctgcagctgagacaatctccgaggtggccaataacttccagatgacatcaccccatgaattggtggtaacatgtcctttcttgaaaggaatctggtcagtgcaactcctcccacttacgtagatgtcaaatggctatacatgtgggtcttaaacaccttttcctaaacacattttttcattcatttgcgcccactggccgggcgtggtggctcacgcctgtaatcccagcactttgggaggccgaggcgggtaaatcaactgaggtcaggagtttgagaccagcctggctaacatggtgaaaccctgtctctaccaaaaatacaaaaattagccaggtgtaatggcgggcacctgtagtaccagctactcgggagtctgaggcaggagaattgattgaacctgggaggcggaggttgccatgagccgagatcatgccactgcactccagcctgggcaacaagatgggaaacaagaatctgtctccaaaaaaaaaaaaattgctcccgctttctataatgacatgagtccaatatttcaaattagaaatgagaaatattacagtgtaccatagtgtattgtgttgtagttcatagctcaattggacctttgtcatcagaacaagtttcaactcaaaaaatctctttagttttgtgagtgctaagatgttttttaaaaatgtattcaggtaatacttgtgcgtctgctgttaatgagatcaagtaataataggatggtcactgccagcaaggtgttggggtctgtgggagaacccacagacaaatgatggcaacacacgacaggaagcagcaaatgtcctgggcgaggggcagcagaaggtccaaaacagcagccatgacacctggcgcaggagaacagcagggagacaaagaagacaaatgcagacatcaacacaataccatcagagaaatatgcagtatgtgttttaggagcagaggaagtggacatttatctaattctgggcatagggtaggctgagaagtcttgaggagccaaaaaagaatgtccaagaaaagctgagttgaatctcaaaagggtctagcgcctgaaacggtttccaaaagcagaaacaattgagtgtagttttgccattataagatgatcagagtgagaatggggctcggacagggtgtggggacagaggtgggtcaggtgcagttgctcacatgtaagagcccctatggctgacacaaaggatactcccagtaagcgaaggtctgcatctgcacagagaggaccaggcctcggagagttagcacatcctgctgaatcctaaaggtgttggagcagaggtaaatgctcgcagcaatgttttagaaacattaatctggttgaggtgggtaaggtatatcacagtgcagaaagatgaaaaaaaaaaaaaaaagaatgaccagttaggacacaattgaaagagttgtaattaaaaaggtgatagtactgtgtttggaaaaagagaaaccacacaaaagacatgttgagaattggagtagacaatacatagcagcacactctcagcagctggacacaaaaagaaatgcacaactaggaacgcttttattattcgaagcttcttgcaaccaaaatattttgctatcactactaagaacagagaattgaagaagcttagattaaggggaaacttgctatgtttggtttgggatttgagatacttctgagacatcaagatgaagatattgacatactactgaacaagcaggcatgaatcttgagaaggagtttttgtttgaaaatttagattaggagtcaacagcattgagctgacagctggggcaaaggaggtgctgagaccatcagggagagagaaggaagaacaaggccaggtcaggacactgaggaacaatggttccattagcgtatgattagtaagagacattcctttccatctgaattgttgaactatttattcatggttttcaatctcataattcaattttgtaatgtgtagtatgattcttcaaatgaatgtgatatccaccctcattaacttttgccatgggatctatgaactctcataaactcttgtagggtacttatctatcttttagacatttaaagtaaatacacataaatgaacagagatggtgactgatagggtttggctgtgtctccacccaaatctcatcttgaattttactcccataattcccacgtgttgtgggagggatctggtgggagataattgaatcatgggggcagtttcctcatactgttctcgtggtagtgaataagtcttatgagatctgatggttttatcagggatttccgcttttgcgtcttcctcattctctttgcctgatgccatccatgtaaggtgggacttgcttctccttgctttctgccatgattgtgaggctcccccagccacgtggacctgtaagtccaattaaactctttcttttgtaaattgcccagtcttggatatgtctttatccacagcatgaaaatggactaacacagtgacaaaatttattattttaaagaatatattactggcccatttaattaacttagaaataatttcaaatcatatttactataaaaaaattgtgtgatacaattctaataatggaacaaagctaacactgcaatggccatattagaatctttattgtgtaaaataaagaataattctatataggaaaaacaatatgcattatgaaataataccaggaaataaaataattcaatccactgtttaaaattacaatataatatgaggaaagatttttatcacatcagtaactatagcggacataatgttcttctattttatttcatttaattttaagttccaaggtacatgtgcaggatgtacaagtttgtcacataggtaaatgtgtgccatggtggtatgctgcacctctcaacccatcacctaggtattaagcccagcatgcattagctatttttcctgatgctttccctccccttacccatgctttcacatgctttcttcctctccctgtgtccatgagttctcattgttcaactcccgcttataagtgagaacatgcagtgtttggttttctgttcctgcattagtttgtggaagataatggcttccagctccatccatgtccctgcaaaggacatgatctcattcctttctatggctgcaaagtattccatggggtatttttaccacctttaatctcttggtgcccactctgagtgagaattgtgaaatttggcctgcatgatttagttgttagtatggctgtggtcaaaaagtcaaaagataacaagtgttggcaaggctgtgtggagaaaatggaaccccgtacagtgttggtggggatgtaaattagtgtagacatgataggaaacaataggaagtttcctaaaaaaatttatataatccagtaattccactactgggtgtatatccagaggaaatgaaatcactctgtgaagggggtacctgtgatcccacgttcatggcagcactatccacgacagccaagacatggaaacaacttaagtgtccattggtagatgaatggataaagagaatgtcacacacacatacacacacacacacatgcacacacgaacattatttagcctttcttgtttgttttctccaagtcacagcaggttcagtgccttgacactttctgaaactaaggaagacatggatgattgggtccagctatttttttctgtccatggggaacatgttttcttagaatggagaatgtggccagagaaaactttggtctgctgtttttacttataactcctcccctaaaggaggtatacttctcatttgagtacaccttaaataattcaaaagatgtaaatttatcaaaatatactcaaaactcctacttcattcatccacagaaattcaaatgtggtatttcaaatctatgtctagagaaaaacagatacttgaaacattttttaaagttttgtatgatttgggctattacaaatatgcccaagacacagttctttaaggaaaccttaaagatagatcctaaaagtcatctccaccacactgcaaggacaatgccttgtccttccctgtccttcccacccagaaggcagggccaaagaattccccactggctcactcttgcctttttcgcctaggtcaatgtcagttaatatcagctcatattgaaccccgcggggagcttggagtgagaggctaagaagggaaactaatggaatctaagttgatgtgacccacgcagcctctggtttcttttagcacccaccggctccagcaatatccttatcactccctcatcatatgtctctgcatcttggcctcctgcccttcctgctaaagcaggtgcaggtcacgggaccagcagcctaagtcacggtaagctaggtgcatctctggctgctgctggttggaagtcaccgatctcagggaaacaaactcacatagcaattcagagttggcgcgaggaccgtacctaaataaacaaggccagatattgactcaagctccccaactggccctgccagcagaggggagagttggcacagtagttagaagtcctcggcccctaggctaataagactatgaagaggagcttcactcttgtccctgccatgtcgtcattattaagtcctggaagtgtctgcctgctcctcttttctaagtcattcttttttttttttttaattatactttaagttttagggtacatgtgcacaatgtacacgttagttacacatgtatacatgtgccatgctggtgtgctgcacccattaacttgtcatttagcattaggtatatctcctaatgctatccgtcccccctccccccaccccacaacagtacccagaatgtgatgttccccttgctgtgtccatgtgttctcattgttcaattcccatctatgagtgagaacatgcggtgtttggttttttgtccttgcgacaatgatagactggattaagaaaatgtggcacatatacaccatggaatactatacagccataaaaaatgatgagttcatgtcctttgtagggacatggatgaaattggaaatcatcattctcagtaaactaagtcattcttaatgacttcaggattgtctaaagtgcagagtgtaaacatatgttcatcatcacctctgaaagtttttttctaaaaaacattattcaatcaaaatgaacaagacatccaggctcggtggctcacgcctataatcccagcactttgggaggccaaggcaggtggatcacatgaggtcaggagttcgagaccagcctggccaacatggtgaaaccccgtctctactaaaaatacaaaaaaaattagccaagcctagtggcgtgtgcctgtaatcccagctacttgggaggctgaggcaggagaatcacttgagcccgggaggtggaggttgcagtgaggcgagatcatgccactgaactccagcctaggcaacaagagtgaaaactccgtttaaaaaagaaaaagaaagaaaagaaaaaaaaagaacaggacactatttatcccactagttgtgggaaataaaaaagataaacttgatagatctcctgccctcctgggtcactctacttaagaaaatgggcacgtccataaatcactgtactcacttgagtcatcaatgtgataaattccatacaagagttttgaacaagagtgagtagaggaaccgcttacttgtgttgtatgtacattgtggagaactgtatcagactgggtcagtaatctaaaatttagctaaacgatgttgttaagtagcagaattgaccagataaccagacttatgggtgaggagatcttgaaggtataccccggactagaaactcccacctgctcacagcctcatcatttcggagtcacgccttgcactgaactggacagtaaatagccctgtggctgcgcagaagagctacttgctgtctatttcaatgcaagctgataatgaactgtgtttcattatcacctcgttacacatgaagagatagaatcgcagagctaaataaactggatcaagataacactgctaatcacccagaattgacgagcaccccacccatgattttatcaaagtcttatacgcctcttctctaggagaaatcaaagcatttccctccatgaagaagaatatacaattaatttttaagagacaagacagaaatatatcagtctgatctaatattcttgttaagggtttagatagagtaagagtcaaaattgacatttggcagtattcaatggctctgagctgcctaggaaaaggacccccgccattatgtagagtgaaatacacaagcctggtaataaatgacctttatcagatatttacgtacttcttgtagaaagggtatgtcaaaagcggtgtgtgtcatattcaggatttctgctcctatgatatacaagcttttactgtcagcaagattcagataatttaccttatttaggtgatatcatgaatcaggtaatcagtgtgtctcaaataggaggttcagctttcccaaaatcatgagaagagttttctaatcactggagttactttgtgccatcgatcttatgtcttatgaatataaaatataaggcttaagacgctttaaaaattttatgcatttgtatgcagcagacttgcaactcacagctgatgcaagcaaggcaacttaagcagtgaagaaagaattgacatgattgacaaataggtcttgtgatttaatttacattaacaatgatgtaatgtgcatactgacctaatgtgtccttacataatgtggcaagcaaagcaacacatagcaaacctaattttgacattcttctgggaaaacgcttttccttatgactaaacttttctttaatatttattttaaccattttggaaaggcttttttttggtagatatgttttaaaatattttaaatgtatctttttatttaatatgttaaccgtgacttataattcagaatgctaattaagtattacgattttgtattaattacaaaaatgctgactactaagggcaatgtgctcccaaacaaaatgtcatccaactactgtgtgtgttgcgtttttgtgtctgttctttataatttacttttagtttctcaccctcctccttttgcttgccaattgtggcttcttactaagccctcttcaatatgcctgaactcccagaatctgatttaggccaagatatcagataactgacagtgttgtaatgatttaaaataagatgttcaaagcaagggattatccttggagtgatgtgtatgagatttagtgcattagctttctgacactggtttttcagtgctttggaagtgtacttcttgattttcagccctgttgctttgtactaaagtaatgataaaaatattccttaaataccatacactgatgaattgcaaatattttggaattatagaaaacacagggttttggttttcgttttggttttaatgctgattcttctatagctacctcttacttctgttcttgaaaatttgtatgtgcatatatttcctgtattctataactctcttatgctctaaagggacattctaatactttacaattatttacaacctacactctatgttttccttttttttttttgagacggagtttcgctctgtctcccatgctggagtgcagtgacatgaccttggctcactgcaacctcagcctcccgggttcaagcaattctcctgcctcagcctccctagtagctgggactataggtgcacgccaccatgcctggctaattttttttttttatttttagtagaaacaaggtttttccatgttggccaggctgctcacgaactcctgacctctggtgatttgcccacctgggcctcccaaagtgttgggattacaggcgtgagccaccacacccggccttcttattaaatagctagattaaaaaatatgctatgtcttacctttctttcttgatttggagaaagtaaatcctcacgtattccttctccctgttgtaactgatagagaaaattagcccagtaacctttcaacttacctgttttttcctcatcttaaaggcttgtgaaatagaacaaatgctaagaaactgattcagatacacaactaagtttgagaattactgtgttaactcattcagagctcaaggcagcactctattttataaataaggaaactgagaccctgagaggggttaagtaactgtagtaagtagcatagctgaacttaaaccaaagtagcctggctccaaagttcttatcttagaaaaattgtctgtaattcagacagtaagcaccaagccaaggtttgtctgagtatgctgacaaccaggtttttgtgtccaggaaatcaaaggggaggaaatgtaattattttctttaataaagcatagcaatttagtattaataatatttacatatatagtgagcatttatgccacttgggggcaagagatttaaagaaatacaagcacctttggtacaacatgacattttctccagcacattccaactgagaacgttcatacctcagtctgacccgattctctccaccagcactggatagaatctcatcctgagacctttatctcttagcatcagatcagcccttttcaatcccaaagatctaactttacatggagaatccacaggaggattgacattgagtatgcttgtcggtacctttgaccatttaaaaaaattaatttccctggtaaaacctaacttgagctacctacttcttcgacctctggctgtacttgcaattttgagttctagctcccaactgcttttgaaagcagacagccgtcatagtgataatacgaaataagagaagcgccatggctgcacttccttgctgtctgcggcctatggctatatatggaagctccactggcagaggctgatgggttatgctcattgctgtgtgcccagcacgttcactgctgccacacacatcccaggtgctcaataaacatgacttgattgaatgaacaaataaatgaatgaatggttttctattcaaatttctcagccggatcccttacctcttccttaagctgatagttgaaatggacttacaattgttgaataaactgtagaaatctttaataacttcattaggaaaaactcgtaatataataattggtttatattagattatcacatgattaatcatcttagtttgtactcttagtcatttccaagcccctgcatacaaataaacctttttctttccaagaatgtatgcaaaaacacaaaaaaggcttacattacaggctctgatattagttatattgacatgatttaagccctccgagaatagttaactagttctaagaccaaaagggcaaggtaacatctttgagtatcacttttcccatctgcaaagtaaagcaataaataactaatccgtaaggctgatgaaagagcatattactttgctcataactaacaagtaacagttagagttcaaatgtggttcatctgactccattttaactatttcagaatgttaataccctatgacatcatctaggagggcactgaggaagagagttcctaaggcaaggtggacaaaacaggcatcactcagcaaagctgaatcaggaaagagctttccaggctgagtttgcttgcagtgtccatggcaggccaggctgaaggctataacccgacctccttagcaatacatcagcaagtcaaataacctgccacggaccagttcacaattaaaagttacacacgtaaagtgtgcaaaactaagagatgcaaagtaaagatgtagttattctaatatgaaataagaatttataattaatggttgttattagttggacataacagagaactttaacaataaaattggaatatttattttacttttttttttttttttagttttttagacacaggctggagtcacccaggctggagtgcactggtgccctcgtagcttactgcagcctcgaactcctgggctcaagggatcctcccgccttggcctcctcagtagctgggaccagaggtgcacaccatcgcacctggctaattttttaaaaaaatgttgtagatatgggggtcccgttatgttgcccaggctagtcttgaactcctggcctcaagtgttcctcctgccttggcctcccaaagtgctgggattacaggtgtgagccaccacatccagccaaaattggaatttctgcttcttcagtgggtttagaatatgcctatttacaaggcaggaaacaattagaaggggaacagtaattgtagtgtcatagtcgcaaagtaggaaagaaacctcctcttgtatacatcattttaaaaggctttgaaggaaaaccaaacctaaatccctctttcacactatttacactacagatatagtctgaaatgttttcattcaaaaataatttttaaattaaagtttgttgaacaaaattaacttgctgaagtacaaattgaaccatggtttttatttaaaatgatgagaacattcaaataatagaagcagaatttcaaatttgctacagttcctgtatttctatgctgtatctatgatcgtctgtactaccctttcagtgccgtatacagggttaaaggaaaagcaaatgtagaataagcacagttcgttattatctttcttttttcttgcagttccgcctttcatacaaccctttgagtttccaagattctccattgggcagcgggtcttcatcccctgtgttgtggtctcaggggacttacccatcacgatcacctggcagaaggatggccggccaatccctgggagccttggggtgaccattgacaatattgacttcacgagctccttgaggatttccaatctctcgctcatgcacaatgggaattacacctgcatagcccggaatgaggccgccgctgtggagcaccaaagccagttgattgtcagaggtgagcaaaggatcatgagccatgtggcatctgtagagttgatttaacaatggtttaagatgatggggcttgaaatatttcgaaaataactggaacttagaaattcagttttatctcactaaaaaaaaaaaaaaaaaaaaaaaaaaatacgactctaaacccaaccatgaattcccctaaactccaagataaggttttatttacctaaaatatgttttaaataattaatagctaagaaggtgggaaccataggatttaattcatgaaataaggcttccgtatgctaagccaatgagttttgaggactaacgtccgtgagcttttgctttattgtattcatataatatttttagtatttcttatttcaataaatggttttttaaaaaatatgtctcaaagctatgtatcaaagtttttctaaagagccatgaaatagcttttcataatgtttgttttagttttagaaatgtggttttctttgcccatctattctatttagcattaaatctatcattattttgggacgccattgcaacgttttaaaattaagcagagtatggtagtacttattcaaaaaaattaaaatagggtaggctaacttgtagaaaactggcagtaatctcattacatctaaactgtaagcttcagtcttattttgaacttctattcaagtcaccaaattcccattaaggctcacactcttcatctatgaaataagctgctagtgttctctaatgtatatcaaacacagacattctgtgatgtttatgattctccaagagtactatacattaatctaccattacaatattcatccacattgcaaaagtaactgtctgaagttaaagatttatattaacaatgattatttgcattttaaaattccccagattgtggtcccagagtggttgttaggagggggaggatttctgtaatttcccagagagtggagatagctctttcttgagcaggagattctcatgtccttcttcattccttactccttgtccccttgatacctcttcttccttgccagctgggaagaaatgcactttttatctacctgccagcaaaaggaagtgacacagacttagaagtcataggaagaaactaactttgtatttctgaaaaaaaaaatttccaggtgaataatttagaaaatatatattcaattagacacaaacttagcagcctcatgacatttttctcatttccaccttgcactttggagtggaagaattgggatacttgattttttcccaaattttgaaagataaataaaaaagggagccaacctagtatctgtttcccaagcgttttcttataagcagagttaactcttgggtttgtgaagggcaaaatagtacatcagcctgctttctatataatctgctctgaaggatccaggccaggaatctgaaacgtcagataaaaatgtacggggatgctttttgtacaacttgcccttgcagaaaaggcaaccagaagtttttaaccaaggcaaaatcagatgagctgaaaatgagcctagctatttgggataatgtagctgatcatgatatgactgatgtctccatgtgattgttcttcaaatatgttaaataagctttagttaaattaatattaaatcaccagtgagataatgcagcctagaggaagaaaatgtgcttcacaaacaggtcagtgtgactggagaaacaggcagggacaaggtgatgtgggactgtggttctcaatccagacagttctgtagaatctcctgggaggcttaagaaaacactgatgtgcattttttggtcccaatctacaccaattaaatcataatctttaggggtaaatccatcttccagatctctggggaattgttcttttttcccaaaaatcactagttagtggttctcaaactttgttgtacattcagattgcatagggaggtctaaaaaggtcctgatgaccaggatgaagctcctgtcaattaaataaccatctttggaggtgggacccaggcatcaataatttgtaaaatccacaggtttattctaatatgtagccaagtctcagttccagccccctgagtaattagaacgtgcagccattttgaggtgtggattttcttctagattaaagagttggcactgttgactttaaccaccacagcactatggcctgattgatctttttagttgtcacactagtagctgtctgaagaatggactgggctagaaagcaagaagagtagttaacaggctatttcagacattcagacaagataaaaatgccttggatgaaggtgttaatgttaaggtcatgagaagcagtggaattcacaatctattttggcggtaaagcaaataaaacacgcttatggagtgaatgttgcaaatgagataaagaagaacctttagtggaatcatgctttgcctaataacaaggtgaatgaaagtgtctttagcagaagcagagaagaaatgaggaagaacggtattgacaaggggaataatggtcaatgatatgggagaagcacctgtcccagcagtcactagggcactccagcatttaaggccccagaataagagaaggaggaatcagcagaagagacgaagagggaaaaggagcagcctgtaaaggaggagaaaatccagtggactgtggcactctagaagcaaaatcagaaataaatcgagaaagagaatattaaacagtattgaatcctgctgaaagtagacaaagaggaaaaccaagagttggtcactggtttaggaagatggatattgtttatgaccttgatggatattgtttatgacctggtgtcattgcagcgagggcttgattagaggagcttcagaaaagaaagaaggtcaatgtgcaggaactcagaaaacacaactatttttatatttttaggaattttgctatcacaggaggcagtaaaatggagacaaagttggaaatggacatggggcaagggcaggagttatttttaagactggatactttacagcctgctttatgcttatgagaataagccagtagagaggaaaaaaatatgtgtcaagataaagaggagattattacaggatcaaagtccttgagttagtgaatgcaaccagaattctttgtaccagtgcagtagtacgttcaaagtagtataataacaaccatggtgtgaagctccagtaggtagcaccaacagaaatgattgaaaattatagggaagggggatgttttgggtcaaagaagtggaaaaacaaaaattatctaataggaccatcacagagtaacaggtaacacatttatcctcctactacaaaccaactataaaattggtctaatatatataagaactgctttcaggaacaaaacaaagtgcatgaagtcagttccaaattcaccccagatagctgcttggggtactttctgcacatgacagagagtgcagagcccaaatagatcacagtgatcttggcaggtggagaaaacagagagagaaattgaaagatactaagatgattactgggtattgaaggacaagctactggagattagggagctattcaaagaaaggtctctagaaatctgtacagggctcctttgcagtttcagctgaatactgttcttcacatgcacagggtgctagcagaagttgcacattgcttgggaatgctggagttctaactagccagaataggggaattcagccgcaatctcaggaatgccacaccctaggagtaggactaatctatccccagcataagggttactctagaccagccctaaaagagcctaagaagattcttggcaagataaaacttctccactagtaagttaattgtgtgcataaacaatatttgacactaaaaaggaagacaacaaaatccagacccccaacagcatagcgtatccacaatgtactgcattcaataaacacaggcacacctgattttatcacacttttcttttttgttgttgttgttgtgtttttttattttattttattattattctttaagttttagggtatatgtgcacaatgtgcaggttagttacatatgtatacatgtgccatgctggtgtgctgcacccatcaactcgtcatctagcattaggtatatctcctaatgctatccctcccccctcccctcatcccacaacagtccccagagtgtgatgttccccttcctgtgtccatgtgttctcattgttcaattcccacccatgagtaagaatatgcagtgtttggttttttgttcttgtgatagtttactgggaatgatgatttccaatttcatccatgtccctacaaaggacatgaactcatcattttttatggctgcatagtattccatgatgtatatgtgccacattttcttaatccagtctatcactgttggacatttgggttggtcccaagtctttgctattgtgaatagtgcctcaataaacatacgtgtgcatgtgtctttatagcagcatgatttatagtcctttgggtatatacccagtaatgggatggctgggtcaaatggtatttctagttctagatccctgaggaatcgccacactgactttcacaatggtagaactagtttacagtcccaccaacagtgtaaaagtgttcctatttctccacatcctctccagcacctgttgtttcctgactttttaacgattgccattctaactggtgtgagatggtatctcactgtggttttgatttgcatttctctgatggccagtgacggtgagcattttttcatgtgttttttggctgcataaatgtcttcttttgagaagtgtctgttcatgtcctttgcctactttttgatggggttgttttttttttcttgtaaatttgtttgagttcattgtagattctggatattagccctttgtcagatgagtaggttgcgaaaattttctcccattttgtaggttgcctgttcactctgatagtagtttcttttgctgtgcagaagctctttagtttaattagatccaaaaagaatccaggaccagatggattcacagccaaattctaccagaggtacaaggaggaactggtaccattccttctgaaattattccaatcaatagaaaaagagggaatcctccctaactcattttatgaggccagcgtcatcctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggcttgttcaatatacgcaaattaataaatataatctagcatataacagaaccaaagacaaaaaacacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtccaattgtccctgtttgcagatgacatgattgtatatctagaaaaccccatcgtctcagcccaaaatcttcttaagctgataagcaacttcagcaaagtctcaggatacaaaatcaatgtacaaaaatcacaagcattcttatataccaataacagacaaacagagagccaaattatgagtgaactcccattcacaattgcttcaaagagaataaaatacctaggaatccaacttacaagggatgtgaaggacctcttcaaggagaactacaaaccgctgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaactactttaaagttcatgtggcacaaaaaaagagcccgcgtcgccaagtcaatcctaagccaaaagaacaaagctggaggcatcatgctacctgacttcaaactatactacaaggctacagtaaccaaaacagcatggcactggtaccaaaacagagatatagaccaatggaacagaacagagccctcagaaataacgccacatatctacaactgtctgatctttgacaaacctgagaaaaacaagcaatggggaaaggattccctatttaataaatggtgctgggaaaactggctagccatatgtagaaagctgaaactggatcccttccttacaccttatacaaaaaattaattcaagatggattaaagacttaaaccttagacctaaaaccataaaaaccctagaagaaaacctaggcattaccatttaggacataggcatgggcaaggatttcatgtctaaaacaccaaaagcaatggaaacaaaagccagaattgacaaatgggatctaattaaactaaagagcttctgcacttttcttttcttcctttttttttttttttttttgagacgggatcttgctctgtcacccaggctgcagtacaatgggccaatctccactcactgcaacctctaccttccgggttcacaccattctcctgcctcagcttcctgagtagcttggattacaggcatgtgccaacatgccaagctaatttttttatttttagtagagacaaggtttcaccacgttggccaggctggtctcgaactcctggcctcaggtgatgcaccccacttggcctcccaaagtgccgagattacaggagtgagccaccatgcccggccacactttgctttattgtgcttcccagatatcgcattttttacaagttgaaggtttgtggcaatcctgcatcgagcaagtctatggggaccattttttccaacagtgtgtgcccacttcgtgtctgtatgtcacattttggtaattcttgcaacatttgaaactttatcattattattatgtctgttatggtgattggtaatcagtaatctctggtgttactattataatgttactattataattgttcagtagccatatgagatggcaaacttaatcgataaatgttgtgtgtgttctgaccactctactaaccaaccatttcccagtctccatttctcagcttccctatttcctaagacaacaatattgaccatttctcagcttccctacttcctaagacataacaatattgaaattaggccaatgaatggccccacaacagtctccggtgtttcagtgagaggaggaatcattcattgcacatctctcactttaaatcaaaagctagaaatgattgcattcagtgaggaaggcatttgaaagccaagagaggccggaagctgggcttcctatgccaaactgtttgccacattgtaaacacaaaggaaaagttcttgagggcaatgaaaaatgctactccagtgaacacacaaatggtaaagtgaaacaacctcgttgctaatatggagaacgtttaaatagtatggatagagaaaaccaaaccagccaccacattcccttaagtacaagcttgatacagggcaaggccctaactctcttctatgaaggctgagtgacgtgaggaagctgcataagaaaagtttgacctggggtcattgtaaagcttagcacattgtttgatagcctgggttagtgggaagatttgtaaagacttgatctaaaataaattagctgttgtcttgaagaaaatataagaaaacaaaaacaacaccccaaaagcaaaaatctcttagctgttatgtatgagccaataagagccaaatctcatagctcttatgacagtggactgatggtttccctgatatcctgctcagtggagtgaccttggcattgattaaggtattagaaataacgcattaggcttcatgaaagagcactcctgccctttgcttcctgttgtggtctctagaccactcacaggaaagcaccaacacaacagttcctatctgtgattccaaaggagggccgttttctcacacttttttatatcttctgatgggtcaatggtttctggcttttaatggtgaactgccacatagagaaacaagcacattggctaaaatagttgactgtcagttgacaggaaaaatgaaaatcatagaaggttgctattttattgccatctgttgatccaatttttgatagaattctcatgctatgattttacttcattcattcattcttacacaaaatatttcttaaatatttgttttataataggtgctgttatgagtgccgaggataccatggtgattaaaataaagacaccaagtctctgcccattaaggttcaaagtctagtgaagggaagagataatgaacaaacaatgtcagttatctacaaggactatgaaaaataaacatgttgtacgtggattgagaaagatggggatgaaaatagtattttaggtaggctgggcaggggaaggctttctggagagatctttgagcagagacttgactgaagtgaaggcgtacgtcccagggaattgtaggaagcgagttccaagcagagagaccaacaagtctgaagactgagtgtggagtgagttttgtgtgttcacagcccagcaagaggcccaaggtgcctcctattaagtaagagaggacagaaagtgtaaggcagagatataagcagaggccaggccatctattctcagaatgatgggaaagcaataggtttaattgtcagtgtcgtaaattaaatcttacctagactttggccaagtcccatctcaactaaatgtcaccaagtagagaatggtggtatttatccatgcaccccctcccacctccaccaaatggctttcattaaaactgaatttctgcccaggtttacagctagggaaacctaaattcattctttggaaatatatagcaacttagaagccatggcttccaaacataaaacgctggactacatttaaaactagaaaaatgcctgtcttattataaccatagtattatttctttaaaaatgaaacaacagaagtaatccaccccccaccaacacacacaaaataagcagatcaagccaaagacctctgtgttttaaacaaccttcattttaggcaacaccaggagtaaacttcctcaaagaaacctatttgaaacttcagatactctcagcctatgtggatcccatgacaagattttggtattttggaatatatatcaaattgttctttttggggagacaggagtgctggttatgtgcacgtaattatgattcagagaagtgtttggcaagtttagccatattgcatcttggagatgtgatgtaattatgtagttgaacctattcatctctttaattactcttcctccctaccagaaaaaccgctctgtattagtccatttttatgctgctgataaagacatacccaagactggctaatttataaagaaaaagaggattaatggactcacagttccacaggtggctgggaggtgaaaggcatgtcttacatggtggcaggcaagagagagcttgtgcaggggaaatcccctttataaaatcatcagatctcatgagactcattcactatcacgagaacagcatgggaaagatccgccccccgtggttaaattacttcccactggatccctcccacaataggtgggaattgtgggagctacaattcaagatgagatttgggtggggacactaccaaaccatatcatgatctattggaaaacaaactatattggcaagccggctcaccacaatatactaaataatgtgttatactaataaaaggaaatctaaatatcatctttaaaaaaggaaaccaacaaccttggggaattatacacccagacaatatagagtactggtggtctttttgttctgtcataagttttggcccaaacggcaacagtcccaaaggcttcacatccttccatctcaggctctgtatcttcttggccagagtcctcctatgaggctgtcttctgctgtccctcagatggcacttccattgggtccactcttctcaaagacctcaggctttgggggtcaccctgatctgcgttattaacttagccatgctccgtttccctagtctataaaactgaagtaataacattcattgattcatgtgtcctttcaacgcatagttgcagagtgctttctgtactgcagatctgtgctgtgcgctgggcatgccatggcctgtgagaaaggaatggttcttgttctcatagcatgcacagcctggtatgggacacagactgttaaacagcaataccagatgagcgtaataaaggctatggtaagtaattaaggcctcagagaagcacttaatcttatccacagcatcagaaacaaatgtgcctgactgagtgagtgctaagctaagatgcaaatggtgaatgggaacttattaaacagacatgaagaagcctgtgtgaagacccagcagcaagaatggtcttggggactggataatagatggggttttagaatagttggggcaaagcctgcaagaggagaatgtcacagaatgcaactggagaccaagggctcaagtcataaaaatcctttaaaatatcccaagagtctggattataccaaagggccatgggaatatgcgatgcttttaagcaaggaagtcacatcatccaatttgtgtcttagatcctttaggtccctgagtgaagaatgaattcaagtgggacagttcgtggcaggtagaccagttagggggctgagaaatctaaataagaggcaatatgggccttgtcctaggttgggttcccttgaaagtagagtgtgaggcacagaattggctggcaggttatttatttgggatgtcattcctggatcccagaatggaaagaatgagattagaaagggagaaaagaaaatcagtaaaagttgctttaatgagctggttgctgctatgggcaactggagctcattcctactgggagccttctaaggaatcacgtagaacagtggttcttgaagtgtggtctctgtaccagcagcctcagcatcacctgggagctcattagaaaggcaaaatattggattccaccccagatgtactgagtcagaatcactggagacaaggtttagcaatgtgtggtttaatcagctcttcaggtgattctgatgccctctaatgtttgagaagcgcaggcacagagcaggcctcataattgccccactggatcggaggaaactgaggcagaggcagagaatttataccctgactcctgtccctcagtgatggacaattgtttttcacatgtcaaggttgcaccagtaaggtgggtaaaggctcatgacttctgagaaggcctgagacagcaaagagagggccgcatccccttagtgcagtgtcctggcaaagtgtgtggaggtggagctgtcctcccagaggtgctgaagccgggtggacagaggggctgtgcccctttcccacataaccagactactcactgtgactggggtgtggcagtggagatgcagagaatttgaggatacattttcaagaaataatcatcagcacctgataaaaagaaatgaaagaagaggatatgaaaggaaattccatttttcttttttgaggaccttaatggatggtgaacaggaacaggtaccattttggaaacttgaattagaggtacctgtgatataagctaatgatggaaggatatggtgctctacacaccaagggaagataaaggcaatcatcgtgatgggagtgggtgaaatagctcaggaggtttgttgagtaagatgtggagaagattgaagacaacaccctgagaagaaggagagggccacagtgggggatcctctctttaataagcaagcaaagtaagaattgtcttgagggcaattctgggaggggtcaaaggatggaactaggagtacgtgaaacccactgagtactcaggaaatgctcactttcattactaagtgactccttgtgggggctcctgattcttttaggacaatttcttaggctgccattttgtagaaaaaaagtatctaggtcgaatattaatagtttctttaaaaaatatctgcactttttaaaaaataaactgctgcttactttaaaaaattgggaactttgttgtccctagggataatggtcattctcatatgcttagagcatatgagaatgatgtcattagttacatgttaaacactgggtcctcattcagacactcccctgccctggaattttaatcttagctggtgatgcagctgtctcaaagtgatgacaacccccaggggaccatatgcctgttgtcttcacattaggctctgggcaggcaaagaaatttgtttagaaacttattactacttttcccaggaatccatcacctctaattttgccaggcagaactcaacccaagcatattcttaaggtgtcagatctgaggggtgtggcctcaggtcttcttgatgtaagtacatggatgttcccagtcttagagttcttattgtaactcacaagttcactttcatgaaagggacctacgtattcactggtacacgataataaatcacttagggattgaatatttacattcatgacagtcttctgtcaaaatttaaaggaaatgtatatgatttggcttattcatgcacttagtaaaatatagcattttcctcaaggtggtctcaagttgcatggtatatcagccaaagaccaaacatctgagctattaattattctctttgctataaaaattaagaagctcacttactgcagaagcttctttcttaggtcttcatgtgactgtaaatcactggggtatctgaagagagaattccaatctatgagcaaagaggtgtacgtgggaaatcccctggctactcctaccagggtcagaaacagttttcaatgatacggggtaattattctactaatttagggaccgtttttatctgtaactaccttatacttaccgtatttctatggttgtttctcatatacacttctttgatgagattttaaggaacatttcgttggattagaaccaaattgaggggaggagtaatggatcaattatgattagacatgcttccagagggaatgcaagagattttctaccctgtccattgatgagcaatttcttgctcttggcagaacttgagccaaatggagcacagaatgtggatggctgcagattttccttccaccctgcagagaataattttggcatggtgtcttcaactttgtcacctgctcttgagttgattggtcacttttactagaaaacttagctctaaataatctctaccatatttcttagagataatttcctcactcagagatagtcattccttattatcttattttaaatatattttcattttcttaaatacattttgtctccgaataccatctacatgaagtaacattgcttatcacttaagcaatatctcagaaacccattggctgtgtaaattatttatttcatttgcaagttgggaactttgctcatcaagaatatgtcaggccgtgcgcagtggctcacgcctgtaatcccagcactttgggaggctgaggctggtggatcacgagatcaggagttcaagaccagcctggccaagatggtaaaaccccatctctattaaaaatacaaaaaaattacctgggcgtgatggcaggcacctgtaatcccagctactcaggaggctgaggcagagaattgcttgaacctgggaggtggaagttgcagtgagcagagaacatgccactgcactccacctaggcaacagagtaagactccatctcaaaaaaaaaaaaaaaagtaaaagctaaacatacctgcatttactaaattaatcaacactcttacagcagttaatatctccacagttctgagaacttttctaatcttaatttatttgatcatcttaacaatccttaaaatgagttccataatcatctccaattttcagataagtaaattgagaccaagagccattttacagtttgcacaaaattgcccaacaggaaatagaaaagctggacaccaagccaatgtgtttaacacttggctttatgctggtagtcattattttctggtgcttcttcatgtgtaaatcattctacagaaagtaaagctagaaaattaaaagcaatattttctccagaaacactgcggtgaattccatctctggctgcttcttgtgtcttgacattttcccttcctcctttgttattttatggccaaagcgatcgtcacgttggctcagatcattgtaacaagcttctaagccccttgctaacttaggccctaaccatcttctcagtctatcatatgtggcagctgagttcctatctacctgtaacacataggctcacatttatgtctcaaaattaagaattctgtatcttgcaaggctgatgagattagccttaccaggaatttctaagtatctactatatggtgtagataattcatctcttctcacatagtttatgactgcctcactgaaagtctaccctgtaatgaatcgctgatctgctgggaaagatacggggattagaatactttcagatgctaccttttctaagagatgtgatacatattaaaatcctaatggcttatctcaaaaaatatgctttctttggggagatatgttttaagtgaaatcatgtttatgttttaggtagggatggttctttacagcacctcacaacattcaccagataagcagtcacttaatatcttgttttttataggcacactagaaaacctttatggtacttcactgcaactactctccacagtccccctttggcccaccgtggtgctgacatctggcataacggactatgtgttctcaccagaattttgggaaaagttcagtcccacattgtattctcgattgcctttacgaggtgcctgttatttctcactttatctcctggtagaggaaaaatcaacatcgaatactttgaccagttcacatccaagatgaatacttatatttgataattactatttgaggcacaaatatatatttgatctacttttttttttttttttttttttttgagatggagtttgactcttgttgcccaggctggagtgcaatggcattatctcagctcactgcaacctccgcttcccgggtccaagcaattctccagcctccgcctcctgagtagctaggattacaggcatgcgccaccacacccagctaattttgtatttttagtagagatggggtttctccgtgttggtcagactggtctcaaactccaggcctcaggtgatctgcttgcctcggactcccaaagtgttgggattacaggcatgagccaccgcgcccagcctgatctgttctttaaatggtgattctgattcaattttccattgagggaatttctgtatatttttgataacacaattaaaagcaaaatattccatccctttgatttagtcaaacttcctccctcgaggccagttttccctagttcaaagggcttttacctgtgacaaaagctcattgatatgaatcagaaaatttttcagcactgaaattactcccttaatttgtcccaaactgccaatagtgtttttattgtcccatgtgtatgaaacagtcttcatattttaatattcattaaaatgattcagtttcttagaatcatacctttactcagtttctggtctagtcttaattactggtgacatttctctcttttcagttcctcccaagtttgtggttcagccacgggaccaggacgggatttatggcaaagcagtcatcctcaattgttctgctgagggttaccctgtacctaccatcgtgtggaaattctctaaaggtatggagttacttgatctacttgttacctgtcaaacatttgctatgttctaaaggattagataagcatttctagatttccagagaagtttcttgcaagtagatacgtatctctgtttccaccaagcctatcattctctcatagacattcctagttgtccacctaggtgtttttattcagacacacaacgtgtctgttgtacataacatgcccttggaaaggccacagagggatggaagtcttttgtgtagattgtttcagcacttaggaagtcctaccttgcccacctgtattacataaccatggtctgcttagagatcactgcacactcgtacatgaagagatgtgagtttaaattgtcagaactactcatagctggaaaactatttccccagtatttagagagatgagtgggtttagaaagttaaagataatatcattgattgttttattccccttattaccttagaatatacagattacacgtcatctccttggcgtgctctttttaaaaacaaacacgcccaatgtcctattgcgattgtctcatgttccctgcttgcacccctaatcatgtttcctcttctaatgcagaacagtagctcctgggttttaggtgacattgtagatattatgcaagtagaaatgtatgacatggaaacgaagagtggaatcatgttagactttggaaaaacaatttctgttcattagggtggcttcttcagaacgcctccttaacggtacttgcaaacatattggaagttctctttcttttctcatttagacacttgaattcagtactatattagttgagggccagatatgtactggtgagatcaaataatcagtcaatcatgacctttttttttttccaataacctaagacctagtatctaggtttaattattgtgaggtatttgtatttgtgttgacttaatcatcatttatactctagatctttcttttttaaaatagcatgttgcattttctcattatggaagcaacaatgaccaaaggaaaaataaatggtacatttgttgcaaccctcctggcatctctcttttgagaaggaaggtaaagaagtggggaaggttgctagacactgtctgattgggaaaatagctaaatttttaaaagtccctgaagcaactcccctgtcacacaccacacaccacatccactgtccatgtgcaaaggacttcttcaaaaataaaatcctgttattcagagtctctgcccccatgactttttatttcctgccgtatttgaagctccattgtgcattattacatggaaacagataaacatcataaatttaatttagtttctatggaagtgcatatttgatattatggacattttccatgacatttgccttcttcaacattatttttaatgcctgtcgttatgcaggtgttctctctctccctgagggtgtttacagttttcactctcataaacactccagcaaatgaacactcctgtatgttaattcaatgcgcatatgtgtaagtgaagtgaaaaggcaccagccatatacaaggctcttactctgtactgcccaagggcacttaggccaccaacagtatgggtgggtaaatgtggcccagcatcctcaccaactagataacattttttttaaatagtctttacaacctgatggttgaaaatgccctctcattttaatttgcatacttagattgttaatgttgtttaacatgttttatcttatgttaacagaccacttctacttctcctttgggaaatttcttattcatgttacttgcacgcttatctctatgtcttatttatttggaagtgtttctacatagattaaataatactttgtctgtcttggatgttactgacattttatcccttcttaccactaacttaaaaattaggttgtaatagtagcttttttgtctttaaatttcatatccaatatcaagtcatcaaagaaaaaaattagaaattgcaattttttaaaaagttaaattccccccaataacatcactcaaagatgatcaaagataactgctgcaaacattttttgtctctagactgtcagtcctgtccccaagcaattgcatacccatagatacacattatacatttttaaaagtttgatgattgttgctggcttataatctttcttcagtcaacaatatactatgtatgtcttgccataacaacaaatatggtgcttaatatgacttttttttttctggagacagagtcttgctctgtcgcccaggctggagtgcagtggtgcgatctcagctcactgcaacctccgcctcctgggttcaagcaattcttctgcctcagcctcccaagtagtagctgggattacaggtgtacaccaccaagcctggctaatttttttgtatttttagtagagatgaggtttcaccatgttggccaggctggccttgaactccgtgactttttaatgtctgtgtaatgtttattgtagtacatcaataattacgtttatctaattactttagttaagattgagttcagccacttaaattcacaagggtttatttttctcataagaggactctggatgtcgacagctcaggactagtttgttggcttggctaagtcatcaggcacccaaactccttatgtgttaggaagagttctgcctctcctagcagcattcttcatcctcaaacgatggccaccaagctatagtgtcaacttcctttcacatttccctgtaggaggaagagcaaagggagatggctgcccctcccacacgactcacctccctttaaggtcctttccagaagtgcatcacagatcaattttgccagcatctctctggatcgctggccgggtcgcccctggctataaagggtccgtaagccatcatggacataatgtgtgttattttcctaagtcagagggggtgttggatacctggcaactggatatctccaacactattgttgaatgtcatatttttggtttttgccagtttttcttttagaaaaatatcgtaatgggccaagtgcagtggctcacacctgtaatcccagcactttgggaggccaaggcaggcggatcatgaggtcaggagatcaagaccatcctggctaacacggtgaaaccccgtctctactaaaaatgcaaaaaaattagccacgcgtggtggcggccacctgtagtcccagctactcaggaggctaagaatggcatgaacccgggaggcggagcttacagtgagctgagatcacgccactgcactccagcctgtgcaacagagcgagactccatctcaaaaaaaaaaggaaaagaaagatatcataatgacttctaatgacttctgtcacatttatctttgtatatgtgttcatttatccctggggataaatttctataagtagagttgctggctcaaggagtaaataatttttataactttcaatatgtattgacaatttgccagcattttattcatttacacaactcacctcagtttgcagtagtgtctgtctcttataaccaaaataatactggatattaggctttttttttttgacattttccaatctgatagagaaatatggtatattgttattttaattatgcaagcagtaaatctatttcttaagaacaatttagccttgcttatggaacatgttttctttcaatgaaatgatcactaagagctgaagtgcagctccctcataaatgacaaaactgtataaacaaaacagattcagcttgtttccttgagagatgcaacagtttaattcaggggaggcagaattccagggtaaatcactgcagtttaaaggtagctattgtagaaatgaaacaatctttgctacaaaaaaaaaaaaaaaaaaaaagtcattacatttttgaccttgggtctagatacacaaagtctgagacattcagttctcttttttgatttatttatttacatgaacaaatgaggcctcttgcctaaaagagatttaaaaaaaaaaaatcagggcttcattctgaggtgggtctcacctgtactcccagaagtccacagcttaatgccattctcttgcatgtatgtcacttatactggagggaaaatagttcagggccatctccttgttacctgctgagaagcgaagagggactgcaaatgcgagagaatagatgatgcatcagcctggggcctggcctgggcctcctttgctctctctggctgtccatagagtctctgaccttcagggaaacttggttgtgggaatgtccaaaaagaagagtcagagcatgcctggggggtgacgctggaggacaatggggagtagtttgcatttaaaatagcattgtcaaaataccccaggagtagggaaagtctgaggaaagacttaaagacagatgagtcctgtgctcctgtcctccgagggagaccggaaggtgaggggccagctagttcccaagagttgggggtagggggcgaggccgggaggttgatgcctggaatgatccagaaacaccaaggaggacattacagctgtggcagagttagtgaaaggaagtcctgggagaggagactcctgcactgggtccccatcagtcattgtaaggacctggctctgcccaagtggggagtgggtatggtgagcaatgagagtggtgatggtgatgcggtctcttcagctgctgctgtgctgaagccagaagctaggaggctagctgggtaattggagagagatggtgtgatctgcctcatgctttaaaaggatcacactggcatgctgttttgaaagcagactgtgtgaaggacaggaatttcagccggagagctgttctaaggccttggccgggatgtggccggaaccagggtgactgcagtggaggagggacaaatggattctgaatgtctttgagtgatggacatactatgggtgtgacaaaaggggagaaccccaggcagtgaggatagtggaagtgccggtgacagacaggacgactccaggagggcagacctgtggctggggtaagatcagggttttgggctcctctctatgcagatacagctgtcaatttccaatataagcaatgataaattttctaaatatcctagattttgatgaatattttctgcattgtcagagcttagaccctctatgttctgttctgcagccatatgcccaacttttgcaattgccagttctgtgttagattgattttgtgctcagtatgagttatttggacatagtgaagaatattccaacctctttctggtttgcaatggtttgttccttgcctttttacacccaaaggacagatattggcggctcacactgtctccttggagggagcacagactgcctgatttccctgtagaaggaacttaatctttttggttctgtgcaccaaagagctgactttgaagtctggtagtttattttctttttttatttttgtgatggagtctcgctctgttgcccaggctggagtgcagtggcacgatcttggctcgctgcaacctccacctcccgggttcaagagattcttctgcctcagcctcccaagcagctgggactatagccatgcactaccatgcccagctaatttttgtattttgggtagagatggggtttcaccatattggccaggctggtcttgaactcctgacctcgtgatccacccaactcggtctcccaaagtgctgggattacagacgtgagccaccgcacctgccctgaagtctggtaaatttttagtctataatttggtgttttccatttggggtcaattttcccatagatgtggtgcatctatttaatatgtagattcaggttattttaaaaaatatttttcccatgaattgtatctctaagtgttctcttccctgctttaattttcttcttcagggtctctgattgtggttccataggattgccacctagtctctgtagctgtcattttctctctggttttttaactcattgatttccattttaatttgttcgatatttttccatttctgttctccatgtcttttccccagcaaggtctgttcttctttgtgccaactccggttctgccttcactgctgtgagtttatattttttctccttctttctctccagctctgccagctcacagttcacccttcttcagccatggctttatagacaagtgactgttttattcacagtcttcatctaagtcgtaatacctggtttcttgttctgtttttttcttctattttgcttattgtatctttgctaggtcttggtttcctttcgaatacagcagccccaagacccccaggggatgactgaaccttggggagcaccaaaccctacatatactatgcgctttcctacacatgcatacccctgataaagtttaatttataaatcaggcacagtaagagattgacaaaaattatgagtactagaataaaattattattacaatgtactgtaataaaagctatgtgaatgtgctgtctctgtctctctcaacatatcttatgtgtctatactcccctattttaagactgtaattgacctcaggtagcttaaaccatggaaagtgaaaatgtggatgagggggaactactgtacttacatttgaagaaaatccatgtccccagaaaaagattgttgtgtacaaatgcctgattcctcagctaaccctacttctaaaattctaagccacatcaggcctggggaagtgccacccacacccacctatgcacactgttttcactgatggaggcttggctctcacctgtgacccactctgctgggacttctgaagttcacagcggtggccctgattccctcatcttcctgcatgctcttctgctcaattaccctgttggttgcccatttacccattctgtagctggaagtttagctattttctaatttcataggaaatagaggttacatttttctaggcttctctctcccatttgctttcatgttgttcccaggaagagaagaagtgctggtttatgcctccatcttcaaatatgaaattctattgtttatatacaaagggtcattaaatttggacttgattttagtaaaataaataaagtaggaatctaggaggaggagtagaaatcatcagttaggagactgggctataagttcaaaccccagccataatacaaccctgtctggttgggtgactgcatgtaaattacctaccccatatgaaccacagcatccttgcagctgaaacagataaaataaggggataaatgtgatgatttagtaagatgactcatagaaagcatttattatggcttctggcacatagccattagtcagtatgtattagctattattaatatcattattgccattatcatgaacttacatggttagccatttgtcctaaaaccatttattgaagagcccaaactttttcatttgcgataccttattgtctaaggggaaaatgtgaatactggagtctgtgtttcagccttctctctgttacactcaattgcctgttcagcaccatacgtattagaagtttatctccttctattttaatgtctgttttgacaatactccccttgtgacttttatttttcaaaaatgtccttgctttttctgcatggatttttgtttgtttgttccttctagatgcatattaagataactttatcaagtttccaaaaaatctggaaaatttggaggatcataaatttaaagcttaacgtgaagaatgctgatgtcattagaatattgagtcttcccagccaataccatggatagtcctttcatgtatccaagtttttcttttatgaacattaataattttattgcattctttccatttgtcagtggtagtgaatttttataagctacggcatctggttttcttttgtcctccttggttttctgggcggaaaggggtcaagagctgtctacagccaatctttgttgagcttgtccttatgtagctgtccacatctctttcttctcccagcaagggtaatgctgttcttaatttagaggagtttctattttccccactctgtagctcatactaagggctgcaatggtgtgtgactctatttcttcctgtctctcttgagattgtatttctccctgccccttttcctgtgtcctttctgctcattgtagtttccccaattccatatttccctggaggctccagagaatccaccattatttggtgcacacacaggtttgctttagctcctccttctcctactgcacccagacaagctgctggaggctgtcacttctgcactcaccacgcacagtcccccagagggcctggctgtcccttaccactagggccctaaaagcaccctcttctgctcagtgtcagcccacctggagaaatcctcccctgtggttatagactcatcacagggggcaacaggaacttgattcttttgttgagagattcatagaaataaaactaggcactccagacagttaactaaacgtttccatgcaagatggaggggaaaacacatgctgtgctcaatactggccaaactgctcaggtgaccctctctggagtcccctcctactttaggggcatgccctggaaaggctcaccttgatcctgcccacaacttccctcccaatgtccaggggacatccctggaaccttctgtagtcctcatggcctatgtctcagaagaccatgagaaatatgagggaaaggacaagcctaagtccctcaagcaggttaattctagagcagattttctgccaacaccagtttcagacctctctggtgagatgaccaagtcagtcccttcctcagcagtcaagagagggctcacactgcagatcacctgttaatcacactgtgatcacactgcacatcatactgcagatcacactgcagaagaccctgcagatcacactgtggatcacactgtggatcatgctgcagatcatgctgcagaccaccttgagatcacactgtggatcataccgtggatgacattgcagatcacctgcagatcacactgcagatcacactgtgatcacactgcagatcacaccgcagatacctgcagatcatactgcagatcacactgtggatcacactgcaatcacactgcagatcacaccatggatcacactgcagatcacaacgtggatcatactgcagatcatgcttcagatccacctgtggatcacactgcagatcacaccttggatcacactgcagatacctgcagatcatactgcagatcacaccatggatcacactgcagatacctgcagatcatactgcagatcacgcttcagatccacctgtggatcacactgcagatcacaccatggatcacactgtggatcacactgcagatgacactgcagatcacactgaggatcacctgtggatcacactgctgaacacactgcaggttgtacattcaaaagataagtctggaaagaagcaaattatcaagagacagaaatttgcttaaataaaattctcttttgtttttcctctgggaaagcagggggtttatattaaaatagctcaatagggagcacgttcatagggcccagttgggatgatactgagttttcaggtcctccaaggcttctccccaagttctggtccctttgtcctgctctgtatgcccttgcatgtttcactctgcgccagcctcgtgcctgagtgcccccaggttcagtgtccaaggcatttcgtctcattctttttttgcccttgctgccactcactctgaccttgaatgccagttccacaggctttgctcagacaagtgtctcttttgcatccctgttctgagaaattgggtctctgcattgtctctgacccttgtcttggtcatctccttgggaccagtggctccaatcctggccctatcttaatcctcttagtgtggatcaccagaataaaacttctgaccacaagcctgacctggtggaggctgctgccctcccactgtcccacccctgcctgtgcatctgcacactattcagtgctctcaccatgcccattcctagactcaccatttgtcttgctctgtgttgtttagagcaccccaagactccacacccatggttttgacctcttccatgtccttcatttcctgaagcagcagtgatcccctgctctgccccagtgcactcctctgatccaggctatcaagtcctggctctcacccagcaccccgatttccaattaggtgataagatgcaaatattgaattaatatggggaaagaattcaaataatccaaaaacgagaagaaggcaacatctctctatggcacacatggtaaaaataaacccaagttcaaagtccgatatggatccctcatgcacaacaaaaggagctctgcttgtgtgttgtgtgttccccaagaagagacaaggggcctcacaaagaaataatgagttcttgaaaacaagttgtaagctgaacagagaaagtgagtgttccatatattgttttattttcttcctttgatggtaggaaaaaccttagcagagcagaaaacctgccttcctctgtgctaccctaatcagcatctcagtggccctgggagctgctgcaggacctctgcagggtcctcacctaaggaagtgtaattaccctgagccttggtggagccaccaggacagtcaaccctggggcccatcttgctcttcctttctttatttttcagcactcctccatctttccccctcatttatttcctgggaaactttctggaagccttcttctaggtgtaggcagtcacactgaagacaaatgtttggggggctcttgctccagggaaacggtggctggagaccttgaatggtagacactgctgcagggctcctcccaggagcaaggcaaagcactggtggaatctgcataattgagtcacctcaaccacttccaatatcacatgaccccttgacgagtgctgaattgtgttcagttcatggatcaattatctgataagtgagtgaagggccaattccctctggctgatttaaaaaaaaaggattcttatgtattagttacataattacgtattagttacagaattagacattgaagtgctagtggactagcaagttgtaacaaatcctgattagacactaatctagaccatgaaatttccattgttgtcattggatagccttcttcaacatagaaatgaaggtattaaggaaagatgactggattgcacagtggacacaattatgtgcacatttacaaaagaagtaacctggacggtgtcacacctggatggtgtggtgtgttatcaagaagggatttaataaagggaattaggggcatgcaaaatcctttgaagcgtggacaaactgcgcggccctttaagcacctgagaagtgtaggaactaagatgcttctcccgtcactgctaacagctgcttctagtgctcaagcagtgatttgtagttctcccacaggcagccataaacctgatgtttggggttgacccatgcatcaatttgctgcttctaaagcaaaataatggcttttccacccttgcacctacaaaattgtttttaagtgcctctcactggtaaaatgtaaaccagaatctagtaacaaagccagggaatgtagttttcaggctttcaagccctgcaatttagggcagagtttagagggaaagtggtagtgctaaagatcaacatacagcatctgacacaaactttcagtgtcataaatattacctgcacagtggtggaagcttctttctcagggattggaaatagctctccagcctggaaccaagccagtggtgtctcaggactatacctctgtccacttcgggattcttctttgtaacagaactcttcagcactccttcactgaataagcattgtatttcagctactaaaccttatttaggtgcaactgctgttgctattcttgctttttctcttatctttccattgcaacctctatctttttacccaatgctttcctgcaatcccccaactattctcagagaggaaaccccccttcctaaagaagaaaaacaaatgcattcttgaggaaaacaccactctctccataaggatgaaagggattgtgtttgattccttggtgaaaagaaagaacagcttaccgcctgaccattgtgcaaaccattggtgaggctaaagagacctcctttccatggtcctgcgactcttcagtcttatttcaccctacaaggggacccctctggatgagctcattgaccaagctctccttgcatgcaggcatttatacccacattcatacaatcttgcttcactttatgtgcacaacaatcctacatcatatgtaaatggattattctccttattcatatatgatgaaattaaggatgcagagaaaataagccacttgctgtaaggcatgggtagtttcagagagcatgagaacctaacccttttgactcttatccaagtgccctctctacagaccagcaaagacttaacagtgaaggaaaaaaattgaaacaattttcttatttgctgctgccttcaaagtgggctcatttggtgacaatctgccgttctttttccactgtccccatactctcagtccctgtgaacacagctatgcatatatttgcaataaataagaaaggtgacccagaattaatataactagcaattcagtatgtgccttacataatgctttaacattttattttcatgtaacggagcattgaaattgtccccacttgacccctgctagccacagaaaattggcagtgttttaattaatgactgctggttaccacattgtatcttctagctaattacctaaagtgcttaccttgtgctaagaagattacaggattttacatattgatgctttgggttaaattttactctttagaataaagatgaatctaaagtagatgactgataaataattctgtcaaaccctggcgaagtctacttccctccaattaaacaaatgctagcccttggaactgtagtcctcatagtagatgaatcagttggcagtgtgttcactattattccatttagtaaccacaattagatcttcagatgcaataacccttcaacttaggttcatttttctgatgaagaaaagatttaatgttttcttaaatgcatttgaaactttatttctatcttcattaggaccttttagtaataaagaaacttacttcagtctagataggaataaacagatcatccttttctgctatttaattgagacgacttagcattgtagttaattttatgttgtgattctttaatataaatgtttcaacaattacaagcatttttctggtgaaaattatttaagaaaaggaaaacaatgtgttgttgacatggatattcatgtaaatttttcaaaccacaccagcatgttatttgattttcagtttcttaaatacagttttatataatttgaaatttttagattacctatcttttttttttttttttttttttttttttttgagacagagtctcgctctttcgcccaggctggactgcagtggcgctgtcttggctcactgcaagctctgcctcccgggttcaggccattctcctgcctcagcctccctagtagctgggactacaggcgcccgctaccacgcccggctaattttttttttgtatttttagtagagacggggtttcaccgtgttagctaggatggtctcgacctcctgacctcgtgatccacccgcctcggcctcccaaagtgctgggattacaggcgtgagccaccgcgcccggcctagattacctatcttatagttatattttttcaatcctatatttggttgagttttcaggttgtgtgtattggactaaatctattctcaatttacagtcaactttgggaacgacattaatagcctttactgattttcaaagtgtgttacaaatttaagcacttaaataaaagttgaaggctttttccttaattttaacttccaataaatctattatcctcacactaatgaacacaatatccacaagaagtaatttgataatttataaaagccaaattctttaaaaatgcagtctaattttataggagaaaaaaatgattatctcaatatatggttaaaaactagctgataatattcaacatcctcttctgattgaagcaacgagaacaaaaaaagagttttgtaaaataattacatagaaacacttccttataacccaaagtgctttggaaaatgaagaaaaagacaaaagctcagtagaaaaatgggtaagggataaatgggctgtttactaaagaacaaatacagatggccaatacattcatgatgctcaaaattatctataaacagaaacaaacaaaaatacaaaaaaaatccgccaaaatgtgcaaattaaaatagtgatgtatagcattgatgcagatttaaaagtttaatagcatacatgtatgaggaaaaaattaaccctcagctagcactgaaggagataacgtttgtacatttttaaggcagtttattgtaaatatggtaatatattttaagatttgaatatgcatcacctttggtccgaaattcttctccctgaattaagcatacagattgcctaccgctatatatatatatttctctccactgatgcactgattgatgagtggagacattcattgcaacgtggtccctattcttgtggaatgggaaagacagacagccatataatcttaaaattattaaataattaaaaagagaatgttagaaagcacaacaatgttgtttgcttactataagccataccaatacatagttcaagaacttcagtgcttctaccatcccataatgaaggttctattattatttccattttacaagttaagaagctgaaatattatgtaacttacctaattttacacgttaggaatctattgctttgtaacaaattaccccaatttagtggcttaagatagtatacatttaatagcttccatttctgtaggtctggaatgcatgtgtggcttagctgagacctctggttcaccatcttcccaacattgcagccaaggggttggctgggatgcagtcatttcaaagcttagctgtgggagggtcttctcccaagctcactcctgtgatggttgataagctttactttctcagactgttgactgaagaccaactcccagttccttcccatgggagcctctccacagagcagctcacaacatggtagctggaattccccagagttaagactgagcgggagggagagagggaagaagaaaaagagatggcagtcatgatctttttagccatagctcctcacccagtatttgtcacagtacaggtgctcagtaattaataaagtccatttgcataaaaacgaaggctacattattttatgtttagaagatattagaaagtccgtaatctctctgaaggtatttacttttttactgtttgaatttttgacaaaaaattcagattccctaatccaaaattctcatgctttaaatcccaataagtaaactagtaaatagctttcattaattatttttcaaaatcaaccactcttatactgatgtatttattttttctcaagcatttgaggccaagaacaatggctcgtgcctattttcccaacactttgggaggctaaggtggaaggatcaattgtggccaagagtttcagacagtctgagcaaccaagcaagaccccatctttacaaaaaatttttaaaggcctagcggggtatggtggtgtctgccggtattatagtcccagctacttgggaggctgaggggggaggattgcttgaacccgggagttcgaggccacagcgagctatgatggtgtcactgccctccaacctgggcaaaagagcaagaccctgtctcaaaaaaaaaaaaaaaaaaggcaccaaaatctgctgtgaactttcatatgaattaaggttttttttttaattattatactttaagttctgggatacatgtgcagaacgtgtaggtttgttacataggtataaatgtgccacggtggtttgctgcacccatcaacctatcatgtaggttttaagccctggatgcattaggtatttgtcctaatgctcttactccccttgcccccaccccctcacaggccccagtatgtgatgttcccttccctgtgtccatgtgttctcattgttcaattcctacttatgagtgagaacatgaggtgtttggttttctgttcctgtgttagtttgctgagaatgatgatttccagtttcatccattttccagtttcatctattttatggctgcatagtattccgtgaagcatgtgtgccacattttcttgatcaagtctatcattgatgggcatttggattggttccaagtctttgctgttgtgaatagtgctgcagtaaacatatgtgtgcatgtgtcttcatagtaaaatgatttataatcccttgggtatatacccagtaatgggattgctgggtcaaatggtatttctagttctagatccttgaggaattgccacactgtcttccacagtggtcaaactaatttacactcccactaacagtgtgaaagccttcctatttctccacatcctctccagcatctgttgtttcctgactttttaatgatcaccattgtgactggcatgagatggtatcacattgtggttttgatttgcatttctctaatgacaagtgatgatgagctttttttcatatgtttcttggccacataaaagtctcatatgaattaagttttaaattatctacattatacaagttgctggtgtaattctgaattttgtacattttgataacttatttccaaggagggagcagatttagggataaaaatggttgtccttttagtctcactttataaaatactcattagctcaagtgaggaaaacatattgaagagataataaaatactgttatgtttttaaatgtttttatccctgactttgaattccttatgaaaagaagaattttaaaaactttttctacttagaatcattttatgaaaattcatattttagatatgtaataaagaactaatgcaaacatgtgagttttgttagtagatgttccctcttctaaatgtacaattatcctacatttacatttctcttaattacctttaaaacagatatcagaaaactatgggccacaattcaaatttggcccacatcctgtttttgtttttgtaaataagttttttagactatcttatttcctcataatgatcaccaacatttatcactatatgctaggacaaagatcaattcttctcagattcagtatttttgaagactcctcctcctcctcttcctcctcctcctccttctcttcctcctcttccacttgttttagagacaagatctcactgtcacccaggctagagtacagtggagctcactgtaacctcaaacccacctcagcctcccagagcattgggagtagctaagactacaggcatgacccaacatgtccagctaatttttaaaattttatagaaatgagggctcactctgtgactctggctagtctcaaactcctggtctcaagtcttgcccccaccctggtctccgagagtgctgggattacaggtgtgagctgtcatggcctgccaataagttgttatgaaacacaatcatgctattttgtttctgtattttctatggctactttcatgactcagtggcagagatgagtatttgtgacaaagactgtatgacctgctaaatttaaaatatttactctctggcctttacagaaagattaccaacctctttctgaaaatgttaagcatttttattcatgaacatggtataactctctaattatttaggtcttatttagttattctcaacaacttttacaattttcagtgggctggtcttgcacatattttgttaaatttattctaaatattttatggttttttgccaatatattttctttttaatttttattcccaattggttgttactattatacataaataaaattgacattgatttttgtatattgatgttgtatcccatgactttgctaaactcattttatagttatagcaacttttttgtttactcttttcaattatctatgtagaaaatcatgttatctgtcagtaaatacagttatattcttatcaatctacattcgtgtacttttattttcttcttattatttttctttttttttttttttgagacgaagtctcactctgtcgcccaggctggagtgcagcgccgtgatctcagctcattgcatcctctgcctcccaggttcaagcagttctctgcctcagcctctcaagtagctgggattagcaggagaatcacttgaacccaggaggcggaagttgcagtgagccgaaatcgtgccactgcactccagcctgggtgagagagcaagactacatctcaaaaaaaaaaaaaaaaaaattcaggttgtcgtatgtcccctctagcagttccattttgatgggaaccacctgttgtggggattctacttgatctcctcattcaatgtgaaaggtccccttaggtaccttatcaatttctctcgtctcttcagtggggctagagacaagttgctgagaaatctaaaccagaaacacgggaaaggaaggcacagccacagtctctgccattgtgagctcgagtgagaccaatacacaagttgtcattagggtatggagacagcaagaggaagtgtctcccattctcctgtcctcagatgcaaagtctgaagtttcctgcttgaggcctgtggagacgtctgacttgttcagctcccgtgtaggttcttgggccaggaagctagcaccttctctctagaacacatctttggcccaaacgttgagcttcctccaggaagatcctcaccccagagctttcccctcaagtccccagatactcaggccagagaagaaaaatgccctgggagagtctttcaaggcctgaatcccattctcccagcccacccaactcctccaggccagaagcaggcagcatggcaggttcatccagtcaccatcttcccagaagtcttctaggaccttcataatctgtttcattatttctaaaatcctttttttttttacccagttgtatataaatccttcatatgaatcataccacattcattataatagcatatcatatctgtgccattccctccttgcatggaagcactctgaggagagaggtgttttaattctgtgctgtcttactgcactaatctgatgtatttatttaaataacattaaatgatattaatggtgtattgtgtgtctagaccggaatataaccaccgttaaagagaaacctgcaatattcctattctctttgtagcctcagacatgtgcagtgagcaaagacttcaaatgccatgtccctggagcactccttgtttacattcatattaagtccctgggaacacaaggaatttatttagcaccatgagagttgtctgcttctgtggttgttctactgtgatttctttgaataatttatcagctacttaacactcatcaaatttggctttttatgtagagaaactatctgtaagttctgttagtttttatctcagagtctgagatactgtcattttaaataaatgcttttctctctaaacaagaattttaatactggaggaaagaaagaaaaacctggtgtatcccgtgactgccttatgggatcagtgtgaagcatctctttatgagtctgtgtgtacttgaactcgttgtcttcccatacttactctcgtttgcatcattgctcgtctttctttttctgtctcaggtgctggggttccccagttccagccaattgccctaaatggccgaatccaagttctcagcaatgggtcgttgctgatcaagcatgtcgtggaggaagacagtggctactacctctgcaaggtcagcaacgatgtgggcgcagacgtcagcaagtccatgtacctcacggttaaaagtaagagagaagaaatgcttcgttttacctagtttaaatacataggtctctgggggcttcctttttcaattgtctccatacatacctgtttaaaagcaacacaaaagaagacccgttggtgtgatatagctgggtttaaagttttgttgttctggaaacatgattgaagaggatggtaaacatccagctaattgttgacagtgtgcccagggccccttgtgtgtggagcatgagccacattcttctcttcctttggttctcacagccattggtatgggctctgggcaacctagcagatgagtaggtctctgcctttaacacccacattgctaccctgttgattttcccgtggaaaaactcaatacatggtctcagatgtgctctttacaaagccttttgtcatgcattttgttatttgcaagctgtcttgtccatggatttccttttaaggatcattttaaaatcaagtgactagcgaacaactacaagacagaaatgtgtaagactaggcttaatgctggcgctgctggcccaatatatagaaaaaggtgcgttataatgaaattattctcatacattggtaactggcaaccaaggaaaggatataaagtgaaccagttttactgagttgtgcttattaacaaaatgatggtgcatctagtttacagtgaatggcttatgcccatttatggaattttccatcgaatgaactgtgatttcttcttgattacaaggctttattcagactcccctcccactttttttttgaggcagaggctcactctgttgcccaggctagagtgcagtggtgccatcaaagctcactacaccctcgaactcctgagctcaagggattctcccacctcagctttcttagtagctaagactaccagtgtatgccactgagcccagctttttttttttttaattttttataaagatgagggtctcactttgttacccaggctggtctcaagctccttccctcaagtgatcctcccctcttggcctcccaaagcactgggattacaggcataagccactatgcctggcccttggatttcctcttttttttaactttaattctgctatggatagtttggaaaagtctctactatatgatttattagaagaatgagatttaaaagtggcattcaggggtgtgtgtatttgtgtgtgtatgatattgaaaggctagctaaacagacaagtatccatcctaactcacgaagaatttattttagttagtccactatttccaacagaacaaaaaaaatccaagtgtttatttattaaagttttatattgtgaaatggattataattatgaaatggggttgttttggaatatattttgcacatactcaatacctagtttttgacttttaaatcgtatgctctggaggaaatgatgtgcaagaatttgataacgaattgtggtactgtttaaatccagagctgaaatggtaatttttaaaagttataaaggaaacctaaaatctgaggagcaatgttgaccagagtcggtccatctttccccaaggaaaggggtgtattttgcagttattttaatagactttaaatgcataagacaattttttagtccataaacacatatctaggacccaatatatataagaccctatgaaggatacaagtacaatcaaccatgggccttaccctcatgagtgacaagcctcatgttttggaaggggagataaccaggaagaagatagaagccactgattacaatgcagggtgaagagtcacatggatcatgtctgtgacattcagaggaggatggaaatgtcagcttgggggaattaaggaaagcttcatggaaaataggcttcaagaatggacgatgcccccatatgtcctctctccagatctcggtactcagtggcagttgtgcagcatcagggaggactaaggagatgaggtggcccctgccctctaggagcttttgctctctggggataattgagtggatatatgtccaattcctgtctggcagaatacacaactggtggaacagagcccagaacaccagggttcatggaagagggtatgatttgcttctgtttgtagaatcagtgaccgtgtggaatgaactgaatgtctgtgtcccttcaaagtccatatgttgaaatcttaccgccagtgtgatgatactagaatctgaggcctttgaaaagtgattgggtcacaaagggggagccctcagggatggaattagtgtccttatcgaagggaccccagagagctctcctgttctctgtttccaccatgcgaggatatacaagaaggtggcaacctggaggaggatgctagaacctgcccctgctggcagccccatctcagacttccagccttagaactgtgaggaatacatttccgttgttgataagccaccaatgtatggcactttgttacagcagccccagttgactaagaaactacggaacgaaaagctgcagcatctgagttcggtcttaaagacacaagggccttcaaaaggcaggactgttgaggctagatagggtattccagggacaggagacagagaagccagatacaagaaactgaaagactccaggcaagagtaactctctgttcgaatgttctacagtacatggaggagatgggagaggagaacatttaaagtgaacacacttcaaagagagatgatagagttggccaaattttagattcttaaactaatacaagctagtcatggacaggtggatttaaataagttaaatgcacctcttcatgactgtttgtattagtttatctctctaggcctagaaaataggaagaactatgccatcttcatagagttatcatgaaaattaaacagggtaacacatgtgaaaacacattgtaagacataagatactctaaataagtattccaatacatacatagagtaaatgattctttggttggaaagaaagagaaaatgtatattgatggcacagtgcataggagcatttccagaaagttattctgaaaaaaaattaaaaggccagaggctaggaaaagggaagaagaaagaggacctccatggcccatggggaggtattttcatccttgtctaatactcgtccaaagctcagccctggagtggtgtctttagcaactctaatggccaatgtcttttgcctaaccctagttgtttaagaacaatcagtaaagtgttttaggatctcaaactgaaaaaaaaaatagatataaaggagagtttactggtctaaataaacacattaagtactctcccctttctgtaagtcattttaaaaaatgggctgcaaatatttctaaattcaataggggagaccttgctgtctaattggatgatgtcaggaaattaagacagctgctcctgcagcaagtctggactcccaggatggcctggtgctggctgtaaacataatttaaagacccaaactctccggataggacctgcttctgggggctcactgtgagatcctgcgaaccctgcacagagggtttctcctatatgggaaattttcttactgctttcaagaaacatcactccaaaaataaagcattttaacaataaacacccaccacatacacacacatctttttgttgttgttattgaatcaagcataaggaagccacaggcaaagaagaaagccagcaagcatgtatggaattgtcatggaaagcaatcaatgggatggaaggttactgcatgcaaatctttccagctctgttggggttcctgtctgtgagtctacactgtcatcacaattctggtttatgttttacccaaaataattatcatgtgagataacgattaggaggcttggcagaaaaggcagagggagtaggctctgcttgcaatcaaatttggcctctggtgatgacatcctgccctatgctccaggccgatcgggggctacagaagctatgccacttatgtgccccttcccccaaccaggaactgtttgaggcccagggaatgactttatgttaaaaaaaaaaaaaatagctctgtcaatcgaggaaaataatgagacaagtctcaatcattttaggatatttatttgccaaagttgaggatgctcccaggagacaggtctattcctttctccgaaggtgattttgagggctccaaatttaaaggggaaaggatgagatattgagaagcacacagctttcacataaacaaaaggggcagaggaaaactgtggggaatgtgcattttacataccacagacaaaatggagaggggaacgttcagttatacatttgtgtctggtgggcagagcgactgcacctgtaaagataggctatcaagttgcattgccatggggaagctttaacagctcaccaggaatttccttgtgggcaaaatatgagggaagcgtgtagcttttcatcttgtagccatcttgtttaggaaccaaaaggtggaggcagatttgcgtgacccagttcccagcttgacttttctctttggctaaacgaatttggggtcccaaaatttaatttcctttcacagctccaaaacccactgaatctcttaaatggatagccatccctaaggtttgtctcagatgcccaaattacatcctccccgctcccaactttctgccactggctgatctgaagcctcgtgtttccgggaacactggtttcagcgtgaacctgtggcccacagtgaacaagccgctctgcttttgtgagctgctctgcataggtcctttctgatccctgcatgcaggacaaaagagcaccgcttatcaaacaggaacaggcgcttccctggagagtcagttactcttggaatctagtgaacccccaagctcccaaagttagcccgtgggctctagtccagcctatgtaatgtggtctccctcctccatgctgaatccaggaaggtctgtgggtcgctgtgcccatcagatttctgtactgtcagaatgcaagtgcacacatgtgcatgcaccaactcactcagctctgacctgaccgtctgcagggtcttggctatttctggacagatctccatgttatgatttgacctcaggccactctcaagccctgccattgccagggcagatatgttgggcctgacatataataacccatctccttttctgttgaaaacatgtgtatctatgcctggataatccatagtcaacctcctttactttctgccctcacccactgccaccagtacccacaaatctttatcctaacccctaattagctaaatggaaatctccagtcccggtagcattgctctgtgatacttcttggaggaggaagtagcccagccccaagctgcccccaagcggcccccaagctgccccccatggtgaagctttggccaccttgaattaaccccacatgtttcccaggctctttatgatcactcagtctgctgagccaatcacctcccaccaagcccctcttccaacactggaattaaaattgagcatgagatttgggtaggaacacagatccaaaccatatcaatcatcatttctgaattatagtttaagtccttcccaaacatgacaaattagtgcctgaaatagaatatgaggtgtcccaggtttgtgaacacccagcttatgcactttcctaaattcagtcaccagcacccccagcagtcctcccccaacaatttatcctgcacatatgcaacactcagatccctcctgcttcactctcaagtccagttgccagatacgtctgcaactttgctgggagtttttccaaggaaggagtctcccgcagaagcttcagagggactgcagctgtgccagcactttgattttgcacttctggtccccagaattgtttaagcataaatttctggaggcagaagcagagaatgggaagaatccagggaacgtaagtgtgctggaggggacattgcttagtgaaggaaacccctcagcagctgccacgcccttggtagggcatcctgagctccacccaaacatatgcatttcccttcctaagtcagcctgaagttccaccagctaaagattctctggggtaaaaaaggaatttgtaaaacaggagggtccatatagcagatgcaatttgatccctgctccagtttcaatttccctcctttctctgtgctaaaaattgaattatttcccgtccaccccctagatttgtatgttgaatttgtaacctccagtaccttatatgaccatatttggaaatagcgtacttgcacattgcaggtataattagtgaagatgaggctctactgaagtaggccgccggatccctaatccaatatgactggtgtccttattaaaaggggacaatctgggtgcagacacagatggaaaacatagctgggcaaagacagagattggagttatgctgccacaggccaagagacactgggcaaggcaaggaaggggtctcctgtagaaacttcagagggactccagccctgccagaactttcattttggacttatggcccccagaaagatgtgagaataaattgctgttgtttaagcaccccagtttgtggaactttgttacagcagccccgggacaccatacactcagtgacaacagaactcttttgcggtcttgtgttggagggaagcccaccacaggccagatcccctgcctaagcagaagagtccgaatccatcaaagccactgggtgtgagccctggccgggacccatcaaacgcagcagctccctttgattgaaggatgggcagacaaccagaatttgcacaatgaaacgtaaaaacaattcttttgaggagtttctggagaagatttccgtattcttaatacgggactctgcaaaagaggtttatcccatttaattcttgaccccatgatgtctggcagtacatgagatcacctgggactttattgcctttgctgtctaggccaatgtgggtcagggtttttgcatttgcagctggaggcatccaaactaattagctaaggagagagcagcatctccaattcatggagtgcgattcagccacagtgttcccctcggtaatcctgctgaaataaatggctctgggggaatgaggagttagatctggattgagaagctatagggatttgcagtgcatgctttgggctggggcagaacagctccgtgggaggatagctgaaggtggatggcagcactcggacctgggcacatatggtggcttacagcagggagctcagtacctggtgagggaggttctcctgcctcagcttcccgagtagctgggattattatagatgcccatcactacacctggcttatttttatattttttcagtatagatggggtttcaccatgttggccaagctggtctcaaactcctgacctcagttgatctgcctgccttggcctcccaaagtgctggaattacaggcatgagccaccacagcctttcgaaaaattactggggccagtaaaaatcttatgtttccactccactgttctcctcctcctcctcttcatccttctgttttgaggcacccttctaccaagcaactaaaatgttattattttttttaactttggggtaattgcgcctatttcaatgtttttcagttgatttaaggtccttctgttccatggccttcccctgtggccagtggcactgatgttctgaaccctcaatcagccattaccttccacactggcatctgctgagaagtctgagtgccatatggtccttgactgtggggtcactgcttagttcccttggaatctcctcctgtcttctggctgcccctgaccagacccacccatttgcccatcagcagggttcactgaatgctccctagtgtcaagaattgttctacatcctgcgtgctctgaataagaccaagtattagttcaccgtcatgcagcacaaattcccttgagaaagacatggagatgggtatataacataatgcctggcagaggatacagtgatgtaagaaagcaaggtgtgcatacgtcttggagaaagcattccaggcaaatgaattagcaagggcaaaggctgaagggagaaattggttacatctgtggagcagcagggaccctgtttgctggaatgtatatatgtgtgtgtatttgtatatacttgtgtatatacgcatgcctatgtttgtatatatacacatacagtatacatagacccacacaatccagatttttctttctttttttgaggtggagtttctctcttgtttcccaggctagagtgcaatggcacgatctcagctcactacaacctccacctcctgggttcaagtgattctcctgcctcagcctcccaagtagctggacttacaggcacctgccaccatgcccgtctaagttttatattttagtagagatggggtttcagcatgttggccaggctggtctcaaactcctgacctcaagtgatctgcctgcctcagcctcccaaaatgttgggattacaggtgtaagccaccacacccggcccataatccagattttatgttatatagttatgtgctgcataacaacattttggtcagtgatggaccacatctatgacagtagcccttaagatggagctataatggttaacatacatctaatatatgtgataatggacaacatcctaacattgtaacttaatgcatgactcacttgtttgtggtgatgcttacataacaaacctactgccctgccagtgtacgaaagcagagcacacattatgtacactatgtaatacttgtgataataataaatgactattcatggtttatgtatttactaattgttcataattactttagactactccttctacttataaaaaaaaaaaaagttaactgtaaaacagctcaggcaggtccttcaggaggtgtccagatgacctgttacttgttttttcattttttaattttttctatttcaatagctttaggggtacaagtgactttgatgacatagatgaattgtttagtgataaagtctaggattttaatgcacctatcatctgagtagtgtacattgtactcaatatatagttttctatccctcacctccctcccaccctccccacttctgagtctcccgagtccgttatagcactctgtatgcctttgtgtgcccaaagcttagctcctacttataaatgagaacatgcattatttgctttttcaattcctgaattacttcacttagaataatggcctctagttccatctaagttgctgcaaaagacattatttcattatttttatggcttagtagtacttcacgatgtgtgtgggggtgtgtgtgtgtgtatatatatatatatatatatatgcatgtgaaaatttcaagatgatatatatctaacatatatatatacacacaagatatacaagattaatctatatataacatctttatatatataaaatttcaagattatatatatatatatatatatatatatatatatataaaacatctttgtccattcatcagttaatggacacttaggttgattccatatctttgcaattgtgaattgtgctgtgataaacatagacatgcaggtgtcttttgatatagtgacttcttttcctttggatagatacccagtagtgcgattgctggattaaatggtagatctacttttagttatttgagaaacctccatactgttttctgtagagattgtgctaatttacattcccaccagcagtgtgtaagtgttcctttttcaatacatccatgccaacatctattgtttgttaactttttaataatggccattctggctaggggaaggtcgtatctcattgtggttttaattggcatttccctaatagttagtgatgttgagcagttttttcacacgtttttggccatttgtatatcttcttttgagaaatatccattcaggtcctttgcccactttttaatgggattatctgttttttcttgctgatttctttgagtttgtagattgcggatattagtactttgtcggatgcataattttcaaatatttacttccattctgtaggttgtctgtttactttgatgattatttattttgctgtgcagaagctttttcattaggtcccatgtatttacttttgcttttgttgcgtttgcttttggggtcctagacataattctttgcccaggccaatgtccaaaagagtttttcctagggattcttctagaatttttatggtttcaggttttatatttaagtctttaatccaccttgagttaatttttgtatctggtgagagataggaatccagtttcgctcttatatatgtggctatttgattttcccagcaccgtttattgaataagttgtattctccttaaattgtgtgtctaatccattatgtttttatatgctttgtcaaagatcagtcagttgtaagtatttggctttatttctgagttctccatcatgttccatttgtctatgcatctacttttatatcattacaatggtgttttaattactatagccttgtagtatcatttgaagttgggtaatgtgattctaagaataaatctttttgcttcggatttctttggctattctagctcttttttggttccctatgaattttatgtttttttttttattttgtgaaaaacgatgttggtattttgataggaattgcattgaatctgtagattactgagcagtatggtcatttccacaataccgattctttcaatctatgaacatgggatgtttttccatttgtttgtcatctatgatttctttcagcagtgttttgtagttctcctttagagatcttttcacctccttggtagagtatatttattaagtgttttaaaaataaagtgttttattttctttgtagctattaaaggggttgagttcttttttttttcttttttttttgagacggaattttgctctgtcccccacactggagtgaatgaagtggtacgatttcggctcactgcaacctctgccacctggttcaggcggttctcctgcctcagcttcccgagtagctgggattatagatgcctgtcactacacctggctaatttttatattttttttcagtataaatggggtttcaccatgttggccaagctggtctcaaactcctgacctcagttgatctgcctgccttggcctcccaaagtcaggcgtgagccaccatgcccagcctgagatcgtgtttgattctcagcttggtcattgttggtatatagcagtgctactgatttgtgtatattgatattgtaacctaagactttactgaattcatttatcagatgtatgagtcttttggaggagtctttagggttttctaacagaggtagttttacttccttttttcctatttggaggcccttgatttctttctctttcctgatttctctggctaggactgccagtattatgatgaatggaagtggggaaagtgggcatcgttgtcttgcttcagttgaatgctttcagcttttccccattcaattcagtatgatgtgggctctgggtttgttatatatggcttttcttattttgaggtatgttccttctgtgcctagtgtgttgagagtttttatcataaagggatattagattttatcaaatgttttttctgcctctattgagatgatcatatggtttttgtttttaattatgtttatgtgatgaatcacattttttgacttgcgtatgtggagccatccctgcatctttagaattatcatggtgaattatttttttgatgtgctattggattcgatttgctattggatttggtttgctagtattgtgttgagaatttttgcatctgtattcatcaggaatattggtctgtagttttcctattttgttatgtcctctcctggctttggtatgaggatactggcttcatagaataagttaggcaggattccctccttctctgtcttttggaataatttcagaaggattggtaccaattcttttttgaatgtctggtagaatttaggtgtgaatccaactggccctgggctttgttttgttggcattttttttttattgctgattcaatatcactgcttgttattagtctcatcaggatttctatttattcctgatttaagctatggggttgtatgtttccaggaacttatttatttcctctagattttctagtttgtgtccagagtggtgttcatagtagtctcaaatgatcttttgcatttctgtggtgtcagttgtgatgtctccattttcatttccaattgaacttatctgaatcttctttcttttcttggttaatctagctagtggtctatcaattttatttatcttttcaaataacctccttgttgtttcattgatcttttataatttttttgtttcaatttgatttagttctgctctgatctttgttatttcttttcttctgctagctttgggtttggtttgttcttgtttcattccttgaaatgtgatgttaggttgtcaacttctgatctttcagacttttaatgtaggcatttagtgctgtaaactttcctcttagcaatgcttttgctgtatcccagagattttgataacttgtgtcacagttatcattcattttgaaaaaaaatttaaatttccatcttgatttgatggttaaccccaaaatcattcagaggtagattgcttaattttcatgtatttgtatagttttgagggttccttttggaattgatttctggttttattccactgtggtctgagaagatacttgatatgattgaaattttctttgctctgctcacacgtttattcatccaggtaaacctaaacatgattttgtctatttcaaaaataaccattaagtaattatttatagaataatttaatgtgagggacccacctttttaccatattgagtcattatatccagaaatgaaacttctctttattgtctttagttttctggtagattccttaacgaagaggcacagttgtctccattttggacttagacatattttattaatttttaccaaagaattttgaattttgtatggcattttaaaaaggtatcttggctttctcttttatttgtatagcctaagcacacatccttattaatttaatactattggactcttaattatgtttgaatatttttgcaaaattaacagcctcatggtgagatggccaatggcaagaaagctccaaggtgcatgcacattagtttcaacaggagctgcctgattcttttcattgattcaagaaacatttgctgagttcttaccatgtgccaagcacggtattaggcacagtcagccaagcctctgagctgggattcccaaactgctgtccttgtacctcatttctatcactgccctccagccaaagcccatcagtcacatacttgtagggtaccaagttgagtttattcttgtcatgagctaaagcatacaacatggaaacaatgagatgccttcataagagggtgttgggaaggacgtattataaacttgggcttgtgttaggtgatttgggggaaggttcaagtaagtaggacctaactctggagtgacgctgccagaaagtgggagtaattctatgattgggtattgtcttgatttgttttctgttgctataattattacttgagactgggtactttataaagaaaataggcttatttcttacagttctggaggcggggcaagttcaaggtgaagaggctgcacctgtaagggccttaatgctggtgaggactctctgcagaggctttttgctgcataaagcatgacatggtgaggaagctgacctcatctaaatctaattatctcctaaatatcctgcctctcaaataccgtggttagatttcccaccctcttttgggaggtgggcttaaacaacagaaacttatttctcacagttatcgaggctgaaaagtccaggatcaagattctagcaaggtaagttttattctgaggtctcttttcttggcttgtgggtggctgccatctcactgtgcactcacattacttctttatgtacacatggacagaaagaaagaaagaaagcgagagggagagagagagggagggagggaaagagagagagagagaacactcaagttaactctcaggtgccttttcttaaaaggatattgatctaatcagactagaccttctcatgacttcatctcactctaattacctctcaaaagtaattacctccctgtctccagataccattacattggttagggcttcaacatatgaattttggagaggtactaccattaaatccataacattaaatttctatttgtcagggttctccagagtaacaaagccaataagacatatagagagatagtgctatttattagcatacatatttatatctctttatattggtatatatgtatatacttatataagaatgtgtgtgtgtgtgtgtgtgtgtgtgtgtgtgtgtagagagagagagagaataagtttattataaggaattggcccacatgattatggatgctaagaagtcccaggaaagccaatgtgtaattccaatctgaaagccatcaagctctagacccaaggagagccaatgtttcactcgaagtccaaagacaagaaaagaccaaggtcccagctcagccatcaggcaggcagagtttcttcatactcaatctttttgttcttttcaggtcttaaatggatgggatgaggcccatgcacactagaaaaggcaatctgtttgactcagcctaccaattcggctttaatcttgcccagaaacaccctcacagatacatatagaatcatgtttgaccaaatatgtgggcaagatttctcacccccttagcacagttatataattgtggttaagtttcactgtgagtttcagaggggacaaacattcaaaccatagcagatatttaataaatcttgttcataagatgagagaaatgaagccaggctaatgctgttatgggtaaagaagcagtggtcagtcacgttagacaaaagaacagatgtttggtcattgttgtggtttctttgaacaatgctcatgctattgtctatgttcaaacatgataacggaggggtcttcttttgtcttgatccatctcggtcacagagctgttttgtctgatgttagtgttttgtgaaattgtttatcttcaataacagaacaccaaggcccaggtgggagttcccagccagctcctggatgtcgggggcttttttccaatctctagtttcattattatcatgtaatcatttttaatatcattcatcttgaaaaggatgcagaagacaatacatagttttgtttagacttaattaagaagagaagctacacataagtgctttcatcaagggccactagaccagtcttattgcaaactcagctgaaacaagctcctgacctgcaatgggccttgtgaatgggtacatggaaataagctgatggacaggcaaggcttggagatgtttctctgatgatttattctttgtagaatgcaagtgcctggttgtgatgctcacttttctcttgaggactcccaggtgtgaccctctgcagggaccatcctcactcctcatgttaggacatatccaaagacaacagctacggagcagagtcactgatgcacatttgtaaagcaatggcaggtcatggcaagtgtccatgctacagggcagtgacccaccatctgctctttgcagttcagctgtggctgaggcaggaaggcagagacagggctggaggtggtagacttttgaatatactgttttcccacctatttatttcaatttccacacccttaagccaattgattccagaacctcaagttagatgtccactttttgtggctatccgtttggctactgattgtaagacacattacagaggtgtacagtccatgtatacacaggcaagtaaggatcttctcattccaaagatgcttgagcagaaaagagcacctgattttcagctcattctgaacactggaactgtgactttaatcatcagtatgttgtataataaaacctgaaggactacacaggataagcattgttagttaagaatggctgactcggctgggcgcggtggctcacgcctgtaatcccagcactttgggaggccgaggcgggcggatcacaaggtcaggagattgagaccatcctggctaacacagtgaaatcccgtctctactaaaaatacaaaaaactagtactcttgtaactgtacaagagtacaccgaacaaaggagacagggtcatttataacaggtgtggtggcgggcacctgtagtcccagctactcgggaggctgaggcaggagaatagcgtgaacctgggaggcagagcttacagtgagccgagacttcgccactgcactccagcctgggcgacagagcgagactccatctcaaaaaaaaaaaaaaaaaaaaaaaaaaaaaagaatggctgactcaaaactttcattctctctaagaactattcagtaaccagtattcaactgattccagttgtagccttctttctaaggaaatggaggtaacttttaacttctgggcccagatgcatcgcctctttacaggtgtggcctaattctcatctctggttggtgctgtgggatctgctccatactgggaagtccctgtctagcttcttgccccttattacttagcttctgtatttgctcagagtggagtctttattcttaatgagaaggagggaagccatatgcattccagggagatggtataaccagagaaaaggccctatggcaagaggaagcttggtgtgtttcctccatgacactgctggggtaaaaaaaaaaaaagagttcattaaagaggagatcagatccttcgagggaggtgagaactttgcattgcactctggatggatggccaggctcttcatttttcctttttcctagtaggcatattcatatgtgtaagcgttttctcttttaagaaaatgaaatcacagagtatatgttagtatgcatttgctttttaagttgacaatatatcacagttgtctttccagacgttagaaatacttgttcctcagtgccataaagaaatagcacttcaacataaatttaatctcctcagcagtgccatttttactttctgcagaaggggtacacccgccagcagttttgccccaagagtacaccaaacaaaggagacagggtcgtttataacctgaggtgtccactctactgctgtgtctggtttccattggctggaacgggacctcacattctgtgtttgtctcgattggctagcaacttagaactttttaaaagaggtaaagagagaggagaacaaaagaaggaggaagtaacttgtggaatgctgagaaaggtagaaacaccttcaaataaggaagaggaacaggctatgacctaatgcttgtttggaccagtataagcatgccagggcagatatttaagctaaattgtgggagctaagaacataaagtaccttgatttcttcattgcggctagcagacatttaagaatgttagcacaggtctttgaataaatttcgcttctaagagaagttactgtttattcctatttagatggggaggaaagtctttgaagaggaacctctactttactttttacacagataaatacacatagctccattttattgtatttcaggagtagctcatatttcactttatggtttggcatcattttgcaactgttatcttagttggacattcagcttggaaacaatttcatgtgttcctgtcatttgagaataacatttctaggccttggaagtagtaggttctcaaccagtgtttgcagcaggaagaaatgcaagagggaaagagcaggagagctgatgccagacatagaagaagatctccaggaagaagttttggaagacatgcttttaggttttcatcgcttctcctttttgtatatggtactgctgaatgctgctaggaacaatactttctccccggagatgcaggtcagatgccatgttttctgtggctcatttagattgatacagaatgggccattgctagaaaatggaaacaaaacagtcagaaagcacttcacaattctgagtctgtagccattgattgtaaatgtgcaagaggagaaaagagcacttttgcttaaaaccccattgataatgcagcaaggggaaggtacattgctctgtgaaaagaataaggagaaaggggctttctgtagccataaactgcattaacaggcacataataccatgagtgttgtcattgtcatcacaccatggagccacctctgtgctaccttggccatgtattgaagccaggagaaaaaaacaagggtaagtgcatgagcattaaaaaaattaacgtttggaagtcctgagttgtcttttattttctgcgacctctgagaagcccctctttctcatgtgccactgtaaaattatttccacaactgtaaaaattgggattgtagtaatgctaaatgaatccattctgctcattcagtcctgtctcccaaggtaatcactgtaaaaggctaaggatgatgcattatgagagaatagcatagccatgtggagaggcagtgccagggagtgcgtttgccattgtgtgtgtgtgtgtgtgtgtgtgtgtgttcagcaaatacagccagccctttgaatctgcagcttccacactcatagattcaaccatcctcaaataaaaaatattcagggaaaaaaaaacaaaaaaatacaacaataaacataaatacaaatataacacagtacaatacaacaactatttggatagcacttgtattttattaggtttcatatgtagtctagatggcacctaaagtgtgcaggaggatgtgtgtaggttagctgcaaatactaggccagtgcatatgaaaagtcttgaactctctcagagttttgtatcctgtatgaggggttcctggaaccaattccccaaagataccaagaaacaattgtatctttgttttctttcctctcttatcccattatcatataacatatgatacattgatttgctatcatagtatttaagtattgtcaacttcacatcatagtagtaaagttacgggacattaaggagaggcatgaacatcaccaaaggactttgcttttcttttagggacagggtttgtgtgctttcagttgtgctcagggtagtgatattatgtgaagtggaagtataaccttgttattgtctttatttgaagagtaagtatggtgtaagcagacgtgcatggatgccgagttgacaaggtgtggatttgtgatggttaattgtatgtgtcacttttgctaggcatggtactcagatgcttggtcaaaagccagcctagatgtcgctgtgaaggtatttcttagatgtgattaacatttaaatccatagatttttgagtaaagtagattatccttcataatgcgggtgggcttcatcaattaaaggtccttagaaaaacagactgaagtccctggaagaaagaggagatgctgcctccttcggacccaagctgcacatcagttctttcctgggtacagcctgctggctggcccggcaaattttagacttactagcccacacaatttcatggagtggttccttatcataaatctctctgtctctttgtgtgtgtgtgtctgtctgtgtgtgtctctctctctctctgtctctctctctctctctctgtctgtctctctctctcctattggttctgtttctctgggaagccctgactaatgcagattttgatattagtggcctaaaagttcaggaaggattatattcccacacacatgccttgtagcacccacagcctaaatacctaaatacctccctcagcaaaatgacacatattaacgtgtgcatattttaacatgccgtgaacttccatgctgtttacaaaaagttgaaactgcaaattcactctgtaaatgcttcagggtatgctgcattttaatttgggaatacagagttttaaagactcaagtccaaaacatacattggataccttctgtattagttttctcaagttgccattacaaactaccacaaacttagtgacttaaggaaaatacccttttattatccagagttttgcaggttgggcatccagtggcttggctggtttctctgcttcacatatcacaaagccaaagtcagagcgtccgcagcactgtgctcctcttactggaggacctgggagagaattttcttcctggctctttctgactgtgggcagaattctgctccaggtggctgtgagacagacatcgctgcttccctgccagctgtcagctaggggttgtcctgagctcctataagcctcattctattccttgcatataatcacttacatctcagaattagccaagtgtggggtgagtccttctgacacttcagatctctgactctccttctgttctgtttcttttgcttctgtttctgccacaaggcatggactgactcctctgctttcttattctgcatttaaagtcccatgcgatgtctctggacccacccagagaatttaggatcttctccctattttaagatcagttaattagcaaccttcattccatcagcagaatacctttcactgtgtacagtaacatatttatgttccctagattaggccggggaggtctttgaagcaccattattctgcctactgtattgctatgagcaaggactgtaaatgtcctcgcctttaagtcttttatagactcactggggaaaagagccacatacatgtagtagatcatttgtaacattatctcaaaccataacatggggttgcagagcggaacccggcttcatgaatcacaccacaaaaacggagcgggagctgtctgagtcaccactctctggcacagaacacccagcacacagtaacatacacagcaggtactcaatggttaaagggatgaatggatatagaggaaaactgagtaggagacttaaaaaatggagtcgtctcctcaatgggatttaacatcctttatttacctgtttattccataattatatattggaagtctaatctatacaactgccagtgctgggccttagagatgcaattgtgattagaccagggggcctttacccacacggagcttataatttgacattaatcatatcagcagatgaataatctcacagttaaaacatgcaccaaatataatgaaggcacttactagatggcacgtgagagataagggaaagccactctgaggacgctgatttttgagtggaaagctggataaaggaggattgtcttaggctggcttctggcagggatctgtgtgctggaaacctgctggaaagcgcttgggatcaacgccatagggggagtacaggaagttggagaggcacagaaagaagctgggatgcagatgcaagcagggcccagctgatcctgcaaagagctctgaagctgggtggcccttccaaggtggctggggctgggggcctgggctttatacccacccccgtgaaccagtcaccttgattctgtgtgttaagtcataatgtacctcagttttctggaggtgagacctctgttttcaatggttggaaaagctcatgactataagcatcagatgcattcgtattgccaactgtatcattttgtatgcgtcagaaaatcctttcttgcttagaggaatgggggagcataatgaatcagtttaaatttgctcccatcaccaccttccaccgggttctgagcttttacttatttccttatatcatcatagccagtccaacttaaactgtgatattccaccctccccctgcctggagtgtttggtcttttcattcagggtaacttgcctctattgtaatggggtgatatgatatgaggagatcatgcaaaacaaaggctctgtcatttatcttagctgtgactatttatctaatatttactgaccatcaaagccctcactctgtatggaaaacagccttcaatattgtctgacaccaactgggtatcctacaatttagtttgattcaggcactaattacctggagttcgtatcagatcccatgagttaaagggcaagatccctaacaagactgctcttatgtcagacaccagcagtgagtggggtcccaggcttcccacacttctgcctggatagctgcaaattcaagatagcacaccctccttgggtttgataatctgctagaacctcttacagcattcaggaaaatgccatacttaacaattaccattttaccaaaaaggacatgagtgaacagccagatgcacaggtacatgtggcaagatccggaagggtcctgagcacaggagcttccagccttgtggatctgggttgtgccgccctccgggcgtacccatatattcaccaaccaggaagctgtctgagttgcattgctcagagtttttatctaagttttattacggaggcgtgattgattaaatcattggccacatgactgagatctatttctagcccctcttccttccccagaggtcagggggtgaggctgaatgtccccctcctctcatcacatggttggtctttccagaaggccagcccctccttgataatcatctgagggcccaccataagtcacctcattagcataaactcaggtactgcagaagtagaaagggtctgttgtgagtaactgaagacatttctatcactctgaaaactccaagaggttttgaagctctgtcccggaaccaggaacaaagaccagatatattctgcattgtatcatgtaatcaaatacatgcaatttatttggcagggaatttccaggctccctgctatacagtccctaacagagttaggagaatgataaagaggtaaataacatcctccctcccacgatgctccccaatgccttgcagagacttgtgctacagaattccctcactgtggaccaaccatcctaagcccagatagtttctgtagtgtccatggaaacttaggcatcatcgtcctgtgctcacacttcacctgtcttctccctcctggtttatgtcttcctgctcaggtatgtgtaaggcagataaacatgtcacttcccaattaaatagcaaacagaagaatataaattccatttacccactttacaggcactcccaacctctgtgagtgatacgttctcagccccccgccccttacttgggtctagggggacagacaactcgagccttagcactctctagtaacccaggacaattttctctttctccccacttcccccaattttgttttatacgttgggaagttgtggggactggagtaatgattgagagtagcagaacttaagcctttaatgggaatctggttcccatagtcttgaaaaaagtttaaggatgtgatactttgatcctcaatcttgaatcatagaaacaaagtctagggcaatagtaaaaagtccctatcaaaactcacttgcatgtacctggccacccggctggcccttcttagtattttttttctgattataacaattacacaggttcccatatattttaaaaataaaataatagattgaaaggtagaaaaatctctccttatcccaacactcaaaagatggtgatagaaatatttctctttttcctactcaagatctgaaatttatgagggaaacaaaggaggaaaacaacaaaatctcatttgtcaaagataaaattcatgtgagacaatgctgtttatatctatgggcagatactcctcataacttaagctaagaatccagtaggcttacccagacagtcctaggcatcacaggaccccaataccacctctgtaccctaccaaagattagggccacccatgcatactttatggcataaaggtctgattttattatctatgtctttgtaactaattatcacagattttgcagcttaaaatggcatacacttatgttcttacagtttttgtgggtccaggagtccagacatagcttactgaggtcctggcttcaaccatctgaaacaaacagctttctcaatgtcttcctcaaggctgcaatcaaagtagtagccatggcttaggtctcatctgaaggctcaagtggggatctgcttccaagttcatgtaattgttgtcaggagtcaacttgtggcctcacttactctttggctgttggccaagtaaaggtcacccttggtaccttgccatgaggatgtctgcaacatggctgcttgcttgcaagtgtcgtttgtttgttttgttttgttttaaaaaaaagaaagaaaagaaaacatgcaagtggagaaggcaacagagagagttgaaagatggaagttataatatcatgtgagcttatcaaggaaatgatgtcccactatctttgccatatttaagtgattagaagaaagtcacaggacctacctacactcaagaataggagattccacaagggcatgaatatcaggggacaggatcactgggggctatcttggaatctgcccactacagggtgtttcttaggaactgtcagctcccaacaaaaagtacaggaaagggtagagctgtatatgcctagttcccacttccaaactcattatcaagtgtaagtcattccttctatcccaaattaaaacaagggaagactaggaaataggagaagtgttacctcaacaggtctgatctacgtagaaggaaacatcgggaatggtgagaaaaaccctccctcacaaaaaaaaattaatatagtgataaatctccttgtggcctatttttttttctctctgctaatatgtgctgaagcatttttctgtaactagaaacatctgaatgtactgtttaataacttagcctttattctgatctatatgtgttgatttttttctgtgttactcagtattcttctgctatgtgccttttagtggtctgcactctctatcacatggccagcccagtaactgtgtagccagccctcgatggcccatttgactctggtcccttacagcctccaagctgcatcagcagcatagctccctccaccatatttcattgatgacagaagagaaggcaggcagcatgctgcagcacaagggctgtgggagcccagaagtctgcaaaaaggcctccactcccttttcaggatatcaggtgatagagattgagcaaatgctctgtggtgttatcagtgcccagaactggtctgataagcagggaaagacgccaagaaggacagggtcttggagatgcaggtaacatgtgcacccagcccagccatcacccttttcccattcaaatcttgaacttgccaaggtagccctttattgaagagtgcttaattacttccggccacctccatgaacatgaacatgtcagtaatctttcaagtcttctcattagcagtgaggttgggaacgtcagccccgacccagtgcagcacagcagccctcactgagctgtcgctgccacttcaggaaagtgtcttaatgtgagggctgccttttcacagattagtgacggggatgaaaggaggcaacagtgaagccatctggggattcagacattctgggttaattctttgtgagaaaatgtaaaatggccacattttgcactgtattagcaggccatctatcacaactgtttaagtgtggaattttttaaaaaattatgaaagaaccacagaagatgcatcaagctaaattgaaatttttatctgcagcttaccacatagtgtcatatatacactcttactttatgtcttcctgtcttgatacaaccttaaaggaagtagccttcatctccctttattcatatttctaattgaggcccttgacttttttaaaaaacaccaaaattccttaccatgtagaagtttttcagagatgtcgcagaccacatgaagagtgttggggtccccagatgctgcatgaattaagcttgcgacagaggctgtgaatccccaaaccgtcataggtcattctactggcctgaaccctgcaattgccaaacccaggcaaggatacgacattgtctcatgtttaaattccaaggtcatggagtcaaggtcaatgtgagtagaacctgcaaaaacagtacaaagtgaccatgttctcaaggttaaaagtcaagagaaggacctcagcttcctttgaaatggctccacccaggtctcagatgtgtgtcagcttagggtttccttccacttggaatagtgccaggaggccttgatctcagacaaaataccttgaggcctcttccttattaggggctggggctacacacctaactccttcatccttctttggagcttggaggttgttctcttctcttctggctgcaaggaacccctgcattttccccatgaagccatgattacctcaactctgtgtttcctaaagcttaactcccagcataccaggttgcaaagagagctcacttctgaccctgagacctgccacatcacacactccagagagacagctgccttcatgaacaactttctcaaacctgctgaaatgttgctttcatactcgtgtttgttcacccttcacaattcccatgatttgaatatatttctacgctaatgtatcgttttgttttcatgctgctaataaagacatacccgagactgggaagaaaaaaagtttagttggacttatagttccacgtggctgtggaggcctcagaatcatggtgggaggcaaaaggcacttcttacatggcagcggcaagagaaaatgagaaggatgcaaaagcagaaacctctgataaaaccatcagatctcatgagacttatccactaccatgagaacagtatcggggaaactacccctatgattcagattatctcttacctggtccctcccacaacacatgggaattatgggagtacaattcaagatgagatttgggtgggaacacagagccaaaccatatcagctaatatccaacaatactgcaatttgcataactatctgccctgcttcagatgacaaaactgatgttcattggtatgatttggctgtgcccccatccaaatctctactagaattgtatctcctagaatttccatgtgctgtgggagggacccagtgggagataattgaatcatgggggtcagtctttcctgtgctattcgtgtgatggtgaataagtctcatgagatctgatgggtttatcaggggtttctgcttttacttcatcttcatttttctcttgccgccaccatgtaagaagtggctttcgcctcctgccgtgattctgaggcctcctcagccatgtggaactgtaagtccaatccaacctctttttcttcccagtctcaggtatgtcttcatcagcagtgtggaaacagactaatacagtaaattggtacctgtagagtggggcactgctgaaaagatacctgaaaatatggaagcaactttggaactgggtaaccggcagaggttggaacagtttggagggctcagaagaatacagaaaaatgtgggaaagtttggaacttcctagagacttgaatggctttgcccaaaatgctgatagtgatatggacaataacgtcaggctgaggtggtctcagatggaaatgaggaacttgttgggaactggagcaaaggtgacacttataatattttagcaaagagactggcagcattttgcccctgtcctagagatttgtggaactttgaacttgagaaagatggtttagggtatctggtggaagaaatttctaagcagcaaagcattcaaaagatgacttgggtgctgttaaaggcatttcattttataagggaagcagagcataaaagtttggaaaatttgcagcctgacaatgtgatagaaaagaaaatgccatcttctgaggagaaatttgcataagtaacaaggagccaaatgttaattcccaggataatggggaaaatgtctccagggcatgtcagaggtcttcatagcagccgttcttatcacagacctggaggcataggaggaaaaaatggtttcatgggccaacaccagggtgcccatgctgtgtgcagcctagggagttggtgccctgcatcccagccactccagccatgactaaaaggggcgaagggacagctcaggccatggcttcagagggtgcaagccccaagccttggcagcttccatgtggtgttgagcctgtgggtgcacagaagtcaagaattgaggtttgggaatgtcctcctaggtttcaggagatgtatggaaatgcctggatgcccaggcaaaagttcgctgcaggggcatggtcctcatggagaatctctgctagggcagtgtcaaagggaaatgtggggtcagaggccccacacagagtccctactggggcaccacctagtggaactgtgagaagagggctactgtcctccagaccccagaatggtagatccactgacagtttgcatcatgtgcctacaaaagtcacagacattcaacaccagcccatgaaagcagctggaatgaaggttgtaccctggaaagcctcaggggtggaactgcccaagaccatgggaatgcatctgttgcatcagcatgacctggatgcaagacatggagtcaaaggagatcattttggaactttaagatttgactgccctgctggattgtgggctttcatggggcctgtagcccctttgttttggctaatttctcccatttggaatggctatatttccccaatgcctgtacccccattgtatctaggaagtagctaggctttgattgcacaggctcataggcagaagggacttgccttgtctcagatgagactttggactgtgaactttgggttaatactgaaatgagttaagactttgggggactgttgggaaggcatgattgtttttgaaatgtgaggacatgagattttggaggggccaagggtagaatgatatggtttggctgtgcccccccaccaaatctcaacttgaattgtatctcccagaattcccatgtgttgtgggagggtcttagctggaggtaattaaatcatgggggtcagcgtttcacatgctattctcatgatagtgaatacatctcacaatatctgatgggtttatcagggatttgcgcttttgcttcctcttcatttttctcttgctgccaccatgtaagaagtgcctttccctgcgccccatgatgctgagacctccccagccatatggagctataaatccaattcaacctctttttcttcccagcctcaggtatgtctttatcagcagtgtgaaaatggactaatacattcatcaaggttaaagattgacccaaggccacatataggtgaccagctgtctcagtttccctgggactctctcagtctccacattgaaagtcctgcatcctggggactcctcacacagcaggaaattaaaaagctgagatttaaacttgggccctctccaggctatccactgtgggcttctgcctgatttctagcactgttctttacagtagtatggacttcaccttcattgctgttggatacttcttcaccgtgttagtcatgagtagtgcacatctacccaccccaagatcctgctctcctggggcctctttttttttttctttgatatagagtctctctctgttgcccaggctggagtgcagtggcgagatctcagctcagtgcagcctccacctcccaggttccaacagttctcctgcctcagcctcttgagtagctgagactacaggcatgcaccaccacacctagctaatttttttttttttttttttttttttttttttttttttagtacggactgggtttcatcatgttggccaggctggtcttgaacttttgacctcatttgattcacctgccttggcttcccaaagtgctgggattacaggtgtgagccaccatgccagagcctcttttctgcttctttctggacgtataggaagtgagtatgggattcttgcccatgttcactcaggctctctgaacaggcttcttgaggatgttttttaaaatctcctttggcttttatttgagagtctagattcaggcaacacctcatttgatgccatagaatgagtgttcccatgagctgagcagaggaggtggggtttatagagagaaaaggcctgaggaaagcagatacagagaacaaaaatctgatgggtagtttaaaagtgactgtccttaaagggctaaaacagaagggacttccctatcctgccagcttaggtaagcttggccccttctgatccattgctgtggagctcctagtttttaaggaacaggaacctggatcttatcagcaatctaccatccccgttcctcctcctggctagataagtatgaaagcgtcattgatttgtccagtttcagaataatgaaaagcacaaaagcccatggcagaccagaggtgtaatgtccatggctcagggaggctcacacacaatctcttcctcatttgttaattcctggcataaaggaaaaagagagactatgagctccacccacctaagcgagcctccctgccagcaccaaccctgaaagggtgaaaagcagagattcatgtcatcaaaacacttgcaaaattcccctgacttgctgcttgataggcctcccttcagggagaggtgcaggtggaggcatcttcagaagccatcccagccccgggaacctcatgcgaaatcacccagcaagctatgatggactgggctaccctctcagctttccttttttctcatgtgtcagagaggagctagggtaaatcctgaaaacatgaaacagttcccagacacgaggacttgcccttgttaggataacaggcccctttttgtcctaaagaggtcctcccactcagagggatgagcaaactcagggctgctggctgcctctccagaccaaatgcacagctttgatttaaggacttgcaccttaatcacccatcatgtgtcattaccccaacaggcggcagcagccgtaagacacaagtgccaataaattgtgctgaaagttactggagtgattctttgtttattttctctcacagctattctgtgacacttgggctggcattggaacaacatggttgccacatgtaaggaaggggttcaaggtgactgggggaagcaggagcatccctccctccctccctcgattttcttcctgtagattcccagtgcctcgctcagctctctaggaagtcaagcccttggcagtcggcggaaatgagcactgtctcattagctaattgccagtacagattttcaagtacttctgcatgcaaatcataacagcactgagctttcttgctttttaaaactcctctttcacccatcccaccccctggcttctggaggaaaatgaggtctgttacaaactgcacatcagattacttctggggcttttctggctcacgtttcccaccctcgccgccccaacctgagcagagctcctaactacctacctaccactgctgtgagggaccatgaagcagaaggtgctacttagctttggtccagaacaccttcagcagctttcctcgtgcgccccatcccttcaggattcatctcagacctcttagatctgcatcacagaaaacaaaatgcaaaccaggcacagggacttaagaaaatgattgattaaatggagagtagtctactgctgcacaattgtgactttttttttttttttttttccggagacggagtctcattctgtcacccaggctggagtgcagtggcacaatctgggctcactgaaacctccttctcctgggttcaagcgattctcctgcctcagcctcccaagtagttgggattataggtgtccaccaccatgcccagctaatttttgtatttttagtagagatggggtttctccatgttggccagtctggtctcgaactcctgacctcaagtgatccacccgccttggcctcccaaagtgttgggattacaggcgtgaaccactcttcccggtcacaattgtgaattttaataacagtttggctccaatcagtatgataaaagtcataagatattagttcaccgtgacagaatggtccatttccacatggcagtagaccagtttaaaaatggtctcctccttgtgttgtctaaatggggaaggaacaacccatttgggcatcaaggtgcatttattttccacttgtctttagctgtgctttctggggttgacaggactgaaatgaacatcacagatgggaaatgaccccgtcaccgtcagaggtccctccctctgatgcctgtgtggatcactgccccggtagaccgtctccatgacactgggggaaattaatgtgatgacaagcaatggtggctgctggcaagggtgttccattcctctttctttgcattatccttttctcctccagaaatgctcaccgaattcagcaatcacacctgggcattctctgaagtcatggaatacagtgctgaaacaatgtgtggaggagcaaaaaatctaggattttagaaggctgccatgtcacaggcagggctggctttatgggggagcaaacggtgcagtcacacagggccccacactcagaaaaaaccgatgcttttatttatttactgctgtcatcatcttgcaaatcttagtttttgaatgagaagcttcacatttccattttgcactgattatgtctcctgtacaggtaatatgtgtgaaaatattcttgttaaaagtgctcatttctttccttttttcactacctttcactattgaaaaagaaaaagaaatgcatttaagaagacagtctgtgcttttttaccaaagcaaaacaatccaatcaaggaaatgctcaatccatcccctcccacaaagactgaaattttatttttaaaaaaatcactttattatttttttcctttttctttatgattgtacatctgctttaattctaaattgcaaaatgtaacaggagtattgcagggagacctcttctcctgagctttcatgttccaaagtcagtctaaatacatgagaacattcactgtaacagaatcccaggggtggtcccaaagcacagaccagatcactcagctgtgaggtgggagactcagatatcattagctgtaaatagaaaacaggaagcaaagccccagacacaggggagtcttatgttactagaataaaatgggtaataaggggtcaccttcaaggacagaagttgttgagagaaggacctggtcgtggctggaagagctgtacgtgaggtggaaatgagtggtgggaaacagatccagaaaagtcctgtgccagtgaggatagagggttctgctcagtacgcagcaacctgcttcttagctgcttaaacaaagagttgtttatcactcacacaatatgcccactgtggggttgggggcagggggatctgcttattgtgggctcaggatcccagactgacaaaacaagcaccatttcaaagttgcatgtcacagtgtcaataagagtggcctggatggtgccatcataacaaggcttccagcctggaagccacacatggcacttctgctcacaactcattcactgaaggctacacatggtgcttatgctcacagcttatttgctggaagctcatgtagtacttctgctcacagctcattggctggaagacacacatggtaccacatggtacttctgctcacatttcctgggtcagaagacacatatggcacttctgctgacagctcattggttggaagatacacatggcacttctactcacagctcattggctaaagccagtcatatggccccatccaaccacaagggaccaggcagaacaagtttcccaggtgctcagaaggtagatgagcggaaacatgtgacagacagcactcacgatcaccacagagcctaaaacattactttatttacttgattattttgaccgttcatccatttgttcattcattccttcaggagtccatctaacaaagtcattttctttcttttaaaaaaaaaaaaaaaacttttaggttcaggggtacacatgcaggtttcttccataggtaaacacatatcactggggtttgttgtacagattattttatcacccaggtattaagctcagtacccaatggttgtcttttctgctcctttccctcctcccaccctccccactcaagtagaacccagtgtctgttgtttccttctttgtgtttataagttctcatcatttagctcccacttataagtgataacatgtggcatgtggttttctgttcttgcattagtttgctaaagataatggccttcaactccatcgatgtccctacaaaagacgtgatctcattcttttttatggccgcatggtattccatggtgtatatatacggcagtttctttattcaatctgtcattgatgggcatttaggtggattccacatcttttctattcttaatagtgcttcagtgaacatttgcttgcatgtgtctttatggtagaatgatttatattcctctggatacatacccagtaatgggattgctgggttgaatggtagttctgctttttagctttttgaggaatcaccataccatattgctttccacaatgattgaactaatttacactcccaccaacagtgtatgaatgttcagttttctctgcaaccttaccggcacctgttattttttttagactttttaataatagctattctgactggtatgagatggtatatcattgtcgtcttgatttgcatttctctagtgattggtgatattgagcttttttcatatatttgttggctacatgtttgtcttcttttgaaaagcatctgttcatatcctttgcccaatttttaatggggttgtttgtttttcccttgtaaatttgtttacattcctatagatactaaatattagacctttgtcagttgcatagttttcaaatattttctcacattctgtaggttgtctctttactctgttgatagtttcttttgctgtgctgaagctcttcagtttaattagatcctacttgtcaatttttgcttttgttgtgattgcttttagagtctttgtcatgaaatatttgcctgttcctaggtccaggatggtattgcctaggttgtcttccagggcttttacagttttgggttttacatttaaatctttaatccatctggagttgatttttgcgtgtggtgtaaggaaggggtccagtttcaatcttctgcgtacggttagccagttctcccagcaccattaccattagtcattttctgtgggtaagatgtgatagatcttgatagaatcatcaggatctctgcacccaagaagcttagatatggtggggaagctacaaatacctgttacaaggggatcagtggcactcgtcacaaatggcatgcatgcctgtcaggcaatttgttattggaatgtagaggaggaatccaatattttcacacagggcaatcaatggatactgcacaaaggagggggcattggagctatgtagtaaaaactatgcagtttcagtaagcagaggaaaggacgggaatggggaagaaatttctgacattgggaacagcctgaacaaaaacgtgaaggctggaaaatataaggtaatttaggtagaaaaggctcacatgtaattcactgtcatcttgtggaagacacagaatgctattaaaggcagacaaagtgtaatccaagatgtatttgcagaaaagtaatgaatatctatctatctgtatgcaagatacattagaatgggtagagttagaatagaaaaggaggcaaaaaaaaaaaaaaaaaaaaaaaaccagtgaggaagctactgcagtagctagataagaggggatgaaggcctactgaacaaaggtagaatgggaatagaaaggaaaggtggaggtccctgtgggacaggcaggtagatgtggccagccttcacctgcctggcttgaatgttaatcgggagggcttcctcctgtggttgtatagatcggtgctgcccaaagtggggtctggggacccaccgcatctgcattgcagggggcccaggggcagatcttgtgagaaatgcaaattcccctgggttgtaccctggcaatttgtgttccaacaagatctctgggtgttttgtgtgcacatgaaggtctgagcagctatggtagaggcgatgtgcagtgaatctagcctccctatccagtgttcctgccaggacctgatggaagtataactgagatgctcgcctggagaggcccctgcgtatgtaccccctggaatgggcaggtgttagacaagcatggaatacattaaaaagtaaccatcctaaagcattcagggttactgtataaaatatttccagcccggttttctaagtcttttgcatacaacttttgagtgctttgggaactctttctgaggctggattaagtttctactgctgtaacctatgccacttctgagggaagaagccatattgagcctcatctgtccttctaaatcaagtgactttggaagtttcctataaaattctaggcacttatgttcaattactttatcatatcttcccagcatagaaaaacttcctaacccagatgatctcattcaccttatgctggaaaaagcattacattttatttcctctcttataaaattactttctttatctcttgaaaacttagaaggagcctcttctttcatcgttgctttttttgatttcttcttgcacagtaaagtgattaactcaaatttaagaaggcaggtatccaaaaatagcatatacaaaacaggcctacttctctatcttgtgatctaaagcaatgttgttataggttattatttccttttcctaagaaacttgtgatatcaaaattatatttccagcatgtactatcattatttcttctcactttgaaaaaaaaggaaaaactaattttcctgttctttgctagggcccgattcatctttaagtatccgggtatttaaggttttgacatcctgaaacgctgtgcattcttctctgcagaaaagacctttggagcagactttctagagatagggagaaatgatggtaatccatcataatggcctgattccactctggacacataactgttctccatctctgaagccattcctagggaaagtttaaaagatcataagttagacggtgaatgatacacatgatgctcaaattagaatctactttttttcagagtggcattgacgctgcctctcaagcaaagagaagcaggatcatcaccttatatggggacttatatcactgtcagattcagatgagaagggcacagtcattctcacctgaaagtggtaggattctagaaaattacggaaagtcttttaattcctcccgagtactgcactgtcacctctgggagctgtcaccaaaaagaatagttgcatgtcatttaaggccatgtcaagccggtacttagacatggtttaggcatggaaaaggaaagagatgcttctggatggtgttgcttatttaggcaacacacaaattagtcattttcttttcccccagctgctatggcacatgtgagagaagacgcaatgctttccactcagagcgcttggttgtctctgtcttcctccttctgagaggacacctaggccaacatacctgctaggtggagtttagcggtgaacacctctatcccctctcctactcgctgttaggcccagatgtccccaaaagctatccagctctaccacctccctggttttaaaacacagagcctttggctgtggattattgtgtaaagaggagattctcatgagccaaagtctggcccattttcagttcctccacctggagtgccacatcctgagtatgcttgtccaaatatgtccaagggtcgttttcactggagatgagagagctaactaagaatgcagattcccattccactttccagaccacagaatcagacttgggggctggagtcttatatttctattcctggaggcacccagttgattctttggagtattatggtttaaaaaatcctcagattctaccccagggagggccatctttccttcatttcctcccacatatccccatatctgattcaatttttctcccaatcttccacaagctctttggtagacagaaaactatacaccccctccccaggatgtctgtagcccaacccacggaatctgtgaatgtattactttacatgacaaaatgcctttgcagatgtgattaagggaaagatcttgagatggagagatgaccctggattagccaggcaggcccagtgtcatcaccaggatcttcataacagagaggcaagaggccatgaaccaaggaatttaggcagcccttaagagacttggaagacagtgtggctattcctcaaggatctagaaccagaaataccatttgacccagcaatcccattactaggtacatacccaaaggattataagttattctactataaagacacatgcacatgtatgtttattgcagcactgttcacaatagcaaagacttggaaccaacccaaatgcccatcagtaatagacttgataaagaaaatgtggcacatatacaccatggaatactatgcagccataaaaaaggatgagtttatatcctttgcagggacatggatgaagctggaaaccatcattctcagcaaactaacacaagaacagaaaaccaaacaccacgtgttctcactcatcagtgggagctgaacaatgagaacacatggacacagggaggggaacatcacacaccagggcctgtcagagggtgggggcctaggggagggatagcattaggagatatacctaatgtagatgacaggttgatgggtgcagcaaaccaccatggcatgtatatacctatgtaacaaacctgcatgttctccacatgtaccccagaacttaaagtataataataataataaacttctttagtgcctccagaaggaatacagccctgctgacacccttgagttcagacttctcatctccaaaactgtaagagaataaatgtgcattatttcaagagtgagaacttattccagcagccacaggaaatgtctacaacctcctagctttgttgcagtgtttgttcagcaaacctggactgaacagtctccacagaattgttgaagagctagcgctgggatgtgtgatgggcactagacacctacctttcaggagttgacgggagagttggaagacagttgttcagtcattgtcagaagtaataaagctgtccatggcttctcgcactgttctcctcatgtgccttgcctggtgacattggcagcctcctctcagacactagtaagatgaaacatctttgtttcggttatctgagtgtaattaggtagacactgactgcttactgtagatcagtcatggtcccaagctgtttatccatattaactcatttaataattattcctccacaatgatttcagtactattattaacctcattttaaagatgagggaactaatgcctagggctcagttgaccccaggcttctatgaagcagagccaggttgtgagtctgggcagcctgacccctggtgtcactcaaaacccgtcatgtgctctgtgtctgagggctgggtgtttctttcctttgactacagcacctgagatctagctccttaccccatgtatttgtaccctggaagtaacaccctacagaactggaagttctgtacagattttggaaggataaactagcccacatccacggagacccaccagatagagaagagccagaagccctgggctatggtgaccttacaacacggtgagcgtgagccagagctccgatgctcttcagagtgggcactttgagaagcatattttgacttattcattaatcaaatgttgattaagtttcctctttgggccacaccctgggctcagtgcttggcatatcatacaaagcaaggcaacctgctacctatacacagaaagcagtttctagaatgcaggcaagaaacatgggcagctaagttcaaggtttagaattcttctttaatacatgcagctgcatcggcagaaacaagtttatatatttaagtgtgcagatggaagcaagtgtacagaggaaatttatttccaacccacagtgtttccaccctcgatatggtacttgataatacagccacattgtacttcatcacctggggctttggcaacttttgttttagcaaaacaaccttacttttgaataatagaaaaattatccatgcaacagtgagctttttttcttagtcccgttgatgatacaaacatacgtttattgcatctaatgtgacggagctctctcagtaatgatgatggctgttggtgcagtgtaaagggacctgatttttttttttttctgaaaaggaatgcaagcctggtgatgcatcatcattaacttcctagctgcaatgtccttgggagtgaggccaaatttgcttgcagatgaatacagttgaagaagtgtcgaatcaggtgatcctaaggggtggagaagatacattttgaatggaaggcagtgtttggccctcatgggtgtggtgccattttctttcttccgaatggtccttgagaactaaattctgttttccattatttcagctgagctctcttgctgaagggggacagggtgattaaagagctcagaaagagccctacacagaccgaagtagcagctctcttagtcttaattatcggcctttatgtaacattcttcaaattaaacatacagcgaaagaaaataaatgcctccatattttgaaaacctgacagcttcctctcttgtgttttcctacttcataaggcaaaatgtgtttcttgtagaggctagtacagatggttactctggaccatacggttaactgatatgaaaccactgtctgttttgagtctcatctttgtattttatggtcaccatctggccccctgaccatatcccaatgcctcagtagggctgaaggtggataactccattgtaatgtatcactattttcatagaataatataaacatttgctctgctaatttttgtttcttgcatgtagtgtagtagattctttaattacacaggcaaataaattactcctaatactattgcatttctgaagaggctagtttcatacaaacgaggaagagctgatagtgatagtgatttttattaacaaggtctgctatcattgcagacatagggcaactaagtcataatgccctgatatgcttacgaagatctggagctagacggagaccaagaagcctcctgtgacctgcctctaccctgggcttcggggatacatattttactcacattatatttttaggaaaaacaacccaggggaatcattcagggtacatgaagttctatcagcaaaaaaagaaaaaaagaaacatatccacccaaagaattggcaactggatgcatttaaatgtaccaggaaggaatgacagagaccatgtgactgcagaaaagtgagagaagagagaactggatcaagaacatcatagaataggcaaagacagagaggagaagcaggaaacagaatgctgaggctacaatagacaggagttagaatggtcacagaattttcatattccttatttcccaaaagttcaagaaccagccacatcttgactcaacattaccaagtatggaaaagcacgtaatagcttacaatgatcttttcttacaagtgccaggcccagtgggaactgctttgcttatgtaatctcatttatccttgcatcagcctctgaagtggacatgaccatgatttccattttacaggcaaagcaactgtgtggctcagagatgttaaactacttgtccaaagttgcagaactgttctgtaccagagacgagttgacttctgcgctatgtagatcttcacaacttggatggtcttagtagaattactcaaatttaccttgacccaggcaccatgttgtccaaaaagtaattccatgcctcaagagtaaagtgaaaaccaaatcactgttttaagaccgatataatattctgagaatgcagccatgttccgtgctagccagctcttcaggttcactctgtgacaagagctgttgtacattcccagcatgggccttctggttaagaaggactgcaggcatcattagcctgggaactgagatttgcacagactggctgaatgaactgagtcattcaacagccaaagcgaggcaggaaggagtgtgcagaccttacctgaggctgtcagatgttgatacagcctggagccatcttaacatgcaagaactattactgagccatgaaaaagaagtgaattggagtgataccaggtcatgtggaattgctatgagttattgctgcttgggaaagtaaatgccgagttgtgtgtagtagataccgttctgtcaaatgaactataaccaaaaaattgcgtatgtgtgtacatgcgtgtgtatgattgcagagaaaaatatgaaagggcatacaccaggttattaataaagactagagggcagggatgagcatgagggagtgtgtccatgtggaggagaaggacagaaaggtggacataggggcaaaaagtctctaattatatcaacagcatacgtaatgtgtttccacttgtgcaatattacgtgttgtgtgtgtgtgtatcatacataagaacatattgaagcatggtcagtagaaatttgaccaaaattgcctcagactggttggttgaatttttagtgacctttattttcttcatcagatttaagtatatttgtttaggtgagttttttggagcctgcagatgcttttgagtgaagaaaaaaatatatttaaaatattacttggactttaatatggtcatttattaaagttataaatgtaaaaaccctctttttcagttcaacttataaattttgttattctatgtatgtatctcgtaaatttaaacaagtactcttaagggattttaaaaaaaacttttaggttcgggagtacatgtgcaggtttgttatacaggtaaactgtcgtcacgggggtttggtgtacagattacttcatcacccagataataagcataatacccaataggtgttttttctgatcctctccgttatctcacgtgaagagatttttgattaatgtttagacccatttataaacatagttcattttcttctttatatattaaactacatttataaattatacatatttaatttcctttttaaatactccaattatctaacagaactgttctgggcatcttaataacttataaataaataaacaacatgaataacttagtattattatgactccttaaatatcaccctactaggtttaatctcagtaaaagtcctgcttagtatcacctgtctaaattgattacttaattatatatttaaattagaattacaaatatgataaatactaatatgctatatctcataaaaattacagctaaactgcacagatttcttaccataaaaatagtaatgcttggggcttcttctctaaaacatctctgtatggaattctaactctttctggaggtagaagacacttatctactgagaaaacatgaaatgtcaaacagcttgggcagtagctttccgggcacctttagggatattttcctagtggactgaggtttcttaataaccagagaagtcccttgtagagacactgactagcatcttgtttgtaaaattcaatccctgtctgttctaaggtgtatcaaagggctgtatcaaagcttttcctatgggtctatcataccccatgctccgtagattcatacatttattatctgtctcttatggcaactcacaaaagccagccatcccataacaggtggctaagcctcttgatttaactcaacaagtccatttttggcttcttcatatttgaatttttctcttgtttctcctgtcttcagggctgcaactagaaatagaattcaatcttagtgcataatgagtgacgtcatctgcctgtagttacagttctaggtctgccaatgcagaagtagtggaattccattctgtaaacatgcactgtttataaaatccaaaaaaaattactatattcattgtggggtaaacaatgatatttttcaagtagatatatgggaacatttagatgattcctagaatgtaagataaatattaatcacctaaaatgccaagggtggtgtccagaccagtttctcattgtgctgctcaaatatatatcagattggtaaataaaatatttgatcacaaaagaggaggcattaacttttaatttcagctctgacacatgaagagcttgtaggccatcattctcatctttacaacaagaaaaagctggaggccaggctgggtggctcactcctgtaatcccagcactttgggaggccaagacaggaggatcacttgagcccaggagttccagaccagcctgggaaacatgacaagaccttgtctctacaaaaaatagaacagtcagctgggcatggtcgtgtgctcctgtaaccccagctacttgggaggctgacgtgggaggatcacttgagtgcaggaggtagaggctacagtgagccgtgatcatgccactgtattccagcctgagcaacaaagcaagacactgtctaaaaaaaaaagaaataaaagaaaagcctggaaaaactgaaaatcaacaagttttcttacagagaactgaattgacagagataaactctcacccggaaatctagggagataggtgtcacagcgagatacaacaacagagattggcttacctggaacagaagctgctgggccagtgaagtagcaagaacaagcaaatggcaattttggtacagtgttggtggctgagtgtggactggagtgagagtgaggagctcctaaaggccaccgtcttggggtcgtcctcacactttcacagactttctctctaggaaccttaccagattctcacagtgaagatcaaaccttctccataacaaaggtctactctccacggaaaatttaaaaaaaaaaaaaaaaaacctcttccagaaccacattctgaaattttgtctcacctgcaagaaataaattccttcccactccagccctctccagcctacctatatgatctaagttgtgaaaaaaaaaaaaaagcataatcgagagtcaaggcttcagagaaatggattgggcatgctgcagccagagaacagagcagggatgccgggtgggggttgtggggacatctgtgtacctggaagagaggcagacacttggaaggacacggccctgaaacacaggcccaaaaaacactgagatttaatcataagtatggaacactccccaaccctcacaacttatgaccacaaaaaaatcaaactgccagccaatagcagaaagatagctgtaaaatcctctaatatctgggaattaacacaacacactcttcagttatcccatgagtcagagcagaagtctcaagaaaaattgaacaatatttttaactaagtaaaaataaaaatacttattaaaatgtgtggtttgcagcaaaagcagtgtttagagtaaaatgtatagcaataaatccatatattcaaaaagaagaaagatctcagatcaaaaacctaagtctacacctgagaaaactagagaaagaaataaaagaggggccactatgactggtcccatcgactttaaaaggtcagtgctcacagatttgattattcagataaaattggccaattccagaagttaagcaaagagaaactgataaactgaatagtccgatttctattaaaataattgaataaataattttaaacctttcaaaaacaaaaacagagcacaatgttcagattgcttcactggtaattctaacaaacatttaaagaagaactaataccaatgctccacagtcttacagaaaacaaaagcagatagaacacttcttcacccattccattagtctagcattattctaatatgagaaataaaaacattgcaagaaaagaaaactttgtaccattatttcttatgaacatatgatgacaagtatagaaaaagatgctcgctattatttatcattaggaatatgcaagttaaaatgaccttgaaatagtactgtgcatctattagaatagttaaaatccaaagatctgatagtatcaattgctgacaaggatattaagtaatagcaactctcattcattgctggtgggcatgcagaagtatagagccagctcgacagtttcttacaaaactaaatacagtgttgtcttaggatccagcaattgtacacctgggtgtttgcccaactgatgtaaaaatgtatgtccacataaaaatctgcatatcaatgtttataacagctttgttcgtaattgccaaaaatttggaaccaatcaagctgtgcttcaactgatgaataaatacaaacttttgtttggtacatctctcgacagtagaatattattcagctataaagtagaatgatgagtcaaaccactaaaattaagtgcatattaagggaaagaagccagtctaagaaggctggatactctatgactccatttttatgacattctgaaaaaggcaaaacaatagagttcagaagcagatcagtggttgttagggatttggggaaaggagaggactgaacaggtgaagcatgcaggacatttttagggagttgaggatattatgtatgataatgcaaccatgaatatgtaacaccatgtatttgtcaaaaccacagagccttccagcaaaaagaatgaatcttaatgtaggtgaattaaaatgtaattaaaattttcaaaaaaagcatttaagaggtcatgggaccccaggatgaaatggagactgtgcaaatcaatctaattgtattacaaatgagttaaataactttactaattggatgctgacctaagtaactttggagatgaatggaagctgtatgactaaaggcaaaaagaactatacctaaacattgcactctggttgacaaagttgtttctaacagggacttacttctgaaactactatacatctaaactgtaattaaacaattagggccctgggtggcagatcatgggagttgggtttctcaccatgaagtgggagtttacaaacaagctagggaagaggctagaatgagctgtgtggtacctgattagacttagagacatcagtacgaactcatgtttagctgaatagagatacaatggatacatacaggaatattcatagatgtgtgtatatacatgtgttagtatacacacatttttttttctgtcagctaagagaacctggaagcaaggaacaatgccacagtagcaataaacacaactgtccccaaatcttggtttctaataggattttccaataaaatgaaccaggactcctttgagaacgctaattctaagactggtaagggaatataaaagaacttggaacttccaagcacttggaacttcttgtagagttagaaaataaagaagtaccaagaaaaaaaaaaaaaagaaaagaggtggagggggaaagaaaggataaaataaacaagcaatgatggtgatacatcaataggatgtgggagccacctgaaggagttcccagtggttaaatctggaatcatttgagcaacagaacaaataaggcggtattggattataacccaaagtttaaaataaatacaccctgataagtgtatcagtgtaaaataagtgataagtgtaaaataagcccacactgatataaatgattgaataaatggtaacaatagccaaattttcctgacgaaagaattccaagtaatttatgtagatataccacctcaagaagatgaagcataactctcactccttatgtgtgggctttgcagagcgacttccttccagaaaggacgacatggaaagagaagctttccagtggagaaacctggcaggcaccaccttagccaggtggccaaggtcaacagcgacactgataagccctgttgatagcatttacccttgatatgatgtgatgagaatggtactttacctccgtagtttgccccttcaaaactctcataacctcagcctaaaaatgagaaaaacaacagacaagccccaactgagaggtattctacataattcctgaccagcattcctcaagactgacagtcatcaagaacacagaaagtctgagaaactgctacagaggagcttaagaagacatgatggcagaatgtagaatgggatcctggatgggatcttgaaacaaaccagggacattaggtagcaggtagggtcatctgaacaatgtatgcacttagttaacaatgcattaatagtcattcaataattgtaacaaacgtgccacactaatgtaaggtgtaaataatggaggaactggatgtggagatgtgaagtatatggggacttcctgtgttattatctcaacttttctataaatctaaatgtattctaaaatgttgcttattactttgaaaaaccaaatagaagagcaggtatcctcccaggtgtaccagtaagggtagcagtgggggaaaggggtggtactctgtagctacagacctcaaaatacctgtatgatcttaagacagagtcatcacatttcaaattctgagaaatatcatgggaagaacttgagacagctgctaggcctttagaaaacaatttaccccaaatgttgtctactattggtaaagtagcatttcctatcagcctcagtcttgtgacaggccacaaaaatgacccttttccaaagagttggttaacatgccataagatgcctgccctgttctatcttcaggaaggtggcagctgggaggctgagtcattgtgctgtgattctcacaggatgcacctgtcttctggaaaagctcgaagccttccaaatgctttagtgctgaattctcaggaatgtggcttcagaatgggccagagtcaaccatgacacattttatcccagcatcagtctttgatccttaaatgatttttttttcctcctagagcctaagaaactactaaagaaaatgtggtacatatatcatgaaatactatgcagctataaagcagaatgagatcatgtcctttgcagggacatggatggagctggagaccattatccttagcaaactaacggagggacagaaaacaaatactacatgttctcacttacaagtgggaactatatgaggagaacgcatggacacagagagagtaacaagacacactggagccttttggagggtggatggtgggaggagggagagaatcaggaaaagtaactaacgggtactaggcttaatacctggataatgaaataatttgtacaacaaacccccgtgacacaagtttacctgcataataaatgtgcacttgtacccctgaacttaaaataaaaattttaaaaaatgttaaataattgctgaagtataaacaacataaatggcaaattaacttttggattggttaaagatctatattgctgttcttgaaagaggtctctaaacattagagaatgactttgggttcatttgttacagcctgacacaatgaggtctttgtggagggctgcatgggtttgggacattttgttgccaccaggcctcctcacttagctcttgtccgtatctatatttctttcatttcgtagccaaatagaaaatatcattttaatatagaatctcttctgctgcttgatatctctcccgacattaaaatagcacccctaaagaaatgcaaggaagtgaactgagctattatcaactcagtgttcaagggagaaatttctgtttcaatccaagaaaatccgagaacccactgaattacaaagaattgtctaccaagtaataaataaaactatgtgttccacatttgtgtccgcacattgtcaccaaactttctgtgcatcttatctatgttccttattgcagagttcactaccatttggggagaaagtcaagagcacaggttctgagggccagactgtctggctttgtatcccagctctgcgatgtactaactccatctcttccagccttagtttctccaattgtacaacagggatcataagagaacacatctcattggatagataagtggacgtgcaagagttaatgcatgtaaagcagttcgtaaataagtgctatttatatgtagaaagtctttatcaaacccataagggaatagatattttcatgttggaatcattgcctttcagtgtgaaaatatatcaatgtagtgatggttctgggatcttggtcaatggtggagcatcaccaacacacttgtgtctgattccaagaaggtgttggaggacagggggactttctctgccctctactttcttctccccttagttcacacaaatcgaggctctgaggcctggggaaaagtattgttacctttgtgttctctccatggtcccaacaaagatcgtgtggaccccagcggtaataggtagggatagggaagcaactggcctccgggaatatagagacgtttatcaacaaggtctgcactatctcaggatggatggcggggcctcttaatccctcaacctcctggatgagggatccaggagggcactgttgagtccacacacaaagaagggtggaggagaagatgtcatggcttctttcatatctggcaggattttagccgttttgaagatagagaaggcttaaaggttgaaggtgggaaaattacaaattgtagagtatttgagtgggaatgaatgtgggtaaggggttttgagaggctgtgcctgagatcgctgggggaagaggctgggatggcaatgagcttctaaacacaaggcagatgtcatgggcttggtccaaagggcaaggtgcagccgtgaaatgatggtcaaggtcaagtggttggggcaggtcttgtaaacagaaatgaaggcaggcagtaaagagaagggaaatacaagtacgcatatgtgtacactcatctatcattcacaggcttaccttgttggcaggaggatctgagtctgagaatgggcagtgtctttcatgcagttggcctggccaatctcctgtgaacagggatgtttcagtgtttaccagtacacaacctgagtgtatggtgtgtgtacctcgtgtgagtgtcatgtgcttcaccttgtagcatgcacagtacctccttgaaaaggtagtttctaattcaaaccaacttacatttttatcaagagtccatagagccaactacatgtgggattgaatgttcaggtgaccgacaattcaatttaggacaaaacatggacttgttatcttttttgaagtgtcctttttaacttgaatattcactggcatataaatatgaaacgtaagatgtagccttagagatggttgtcccaatagctgtcatttgagaggatgcagtgtctctgatactcattttagaaaatatgaaagcaaatttttatgtttatttttgactattgtaaaatcttcaaatgcagatttaagatgtcatttattgccaattgttgatttttgctcatttgtgcatcaatattagtttatggaattgaattctctttttgcaacgttattgataattttagtgtatatagtagaaggctgcatttcccaagcagtctttccccatcatagagctcttcccatcagtgtcattgcctctagccagacttcttatgtttctgatgaaatgtgaaagataagcatattcctgcaaggaaaccgtaattgttttcaaagaggagcaaacatctttctttcatttcttctcaacattcacttaaacaattgactaagaacaaaactaccagagatgtgtaaataccagagacatttaaatattaaatatgatatccatttatcaccagatttattctcatttgcaatttaaccagatcttgtttgaaatagtgttggtgttcaatgatgcatgagtgataatcaaccagttaatgaaagattatactgctttgatttcttgggggagaaaaatagactgaatcataggatatttaaagagttcaaaaattctttttcagttaaaaaatccccatttttatacctagccgaaggttttctcaattccctagtacatacattgttatgacactgtgggttattttgagaaattcattttgcttcatcctgatttcattcattcttcacttctctgaaatctaggaaatgcaagtgcattccccagggacccacagcatgtggggtggggtaggggtttccagaagctctccatccttcctgatggaggcaaccatcacatgggcctatctgggcaggtgggaaatatgagagggcatttttgagcaccctctctgttttagagaggccattaaatgtgttcacataagtgttgtcattctcatactcagaaaccattctaaccttcataagtgaatgagagcaactttttattaatgttgtaacttttaacaatttcacattgaaatatagcctaggcattttattagatcatgttaacaaccgctattgatgacttaaaagacaaaaaaatctatttagatagatacatggatgtgtctgagcatgtgtgtttctaattataatgtgtatatatgatatgactgtagaaaaaaaaggtaacttagattttcgttaaagatgtttaaaaatactcttctggttctgagaaaagctgtcttcctattggagctttttttacctgtgtttaggaagcccatatgtcatgctgcaagaaaagaatgtgtttaagagctgaaaatggcatttcccttaggatagtagcagctggaatgaaagcggtgatgatggcaagttcaacgtggctcagaaatgacttgaatgggggctctcaggctcaagtgatgggctggtctctgggttgcaggactaaggaccatgttcaggtgttacctggggttcagggccctgcagcctggggacctcctcaaagctgctctgagggtgagtctcaggaggcaactccaatcctgcaccttcctcttggctcccacatcgggagcagggactgagggcaggctgctgggcaggtctcctggtgtcaggaggggaaagagaggccacaccggacacacctgagaagggaacaaaggttggtagggatgctggaggggagcgtggtcatgggtaaaagaatattgagcaaagaacatttccagggattaaagtttattatatttgcagatttggccctcattctaagaaacttccattagactttagatctttaatacagatcagtatagatttcaaactttaaaattgtctcaattatatagaaggacacttctcaagatttttgatcctaggaccactttataatcttaaaaattcttgaagattccaaagggcttttgtttctgtgggttggatctatcaatatttgctgtactagagattacactgagatatttttttaaatgacaactatgacatattatcataaatatacttcttaataaactatttttagaaattggtgagaagaggatgaattattttacattttttgaaaatctctgaagtctggcttgtagctgcttctgcattcaatctactgtgatgtgttatgttcgttgaagcatatgaagaaaatacaattcgcacagaggtgtagttggacagggaagcttaatagcattttcagatcatcatggctattgctctttgatactctaccaaaatttggcaagcggtggtttttaaagattaattcccatgcagaaccaaaaaccatatcaacagccttttcctaccctattgcattaaaatatatcagtgtttctggatcttttacacatgcatgattttataacaccatgcattggtttttggaaagtatttattcacttagtaatgtagacgttccaaatgttgatgcactccattatacaatacttttgaaaatcacatttataatatcactactaatgtcatccaaaatatctttaaatattgggaaggtgtgttaagcatgtggtgaagaatccaagttttctaaaatcgaattaagacttaaaagctcaaattttaccactggcaacaaacactctcagttgtttcccttgaagtgacaggctcacttcattccttttgagaaaatgtttgtcaaatacccagacaaaaatagtttatcagtttttctttcaagtagaaatgtgttccatgaaaatcacagctgatcagctcatattcagtcccacactggagcttttcttgagcacccaacacacaggtgctttgtatgtttctgccattctgtcacacagaatgttaaaaacgcacaccctcaatggttgagatggaatgaaatgaaatgatttccactgcttagtcaaggacatgctgaagtgaagctgccacgtttgtttttgttgcgagtgttgacggacaattgtgaagaccacaacggccgtgagaagagtttggtgccactgccttgaatcctattaaggccccagcagatttgcccactgttgcttttgtactgttggctaaaaaggcaaataattttttagtgttattctgaaaatagctctgatctcacagatcctttgaaaaagtatcagggatcccaggtgttgttggactgtacctgagatcagttgatacaaaacaatcttatgattactatttatatgtatattatatataatatgtattattttatattatgcatatcatatatattttatgttatttatataataatcctattacgtatgtatattatatatttatatattatacatatatgtattatacacgtacacattattatacatataaatatacatatgaaataatttttcaggttatctagatcttggatctgagtaatccaatcaggtgtctgattgtaatgccctctgcaggctgggtagtgtggtggtggcatgggtgggacaggtagtgtagttctgggagagatccgtctattattcatggtttcactctactcaactctttgaggctctcaactctttttcatcctgtttgacactccacaactcttgcataataataaacagaggtactatagtcaggcaaaaatgaatttaaatccttactttgcttctcactagccatgtgaattgtagcaggtttctgagcacctctgagcctcagtttctgcatctgtgaaatggagataatacaaagctacctcctaggatggttcagagattaatgaaattaaaacctccattgatggagtgacctcagacaacacgttgtaaaagtaagcttgtgcagcctcgtggcccagtgagcacagtgatgagcgcagaaggataaatgaccaccttttggttgggtgctagggtgagcctgctgcatttcctaccgcttttcacacatgcacaatacctctatccaccttggaatacaaggaaataaattgtgtcctgcatctgtttcttcagtcacagttaagctgtgaactctcatggggagtctcatatagctattctaatacatcctcatcactgtgtggcaccaaaattgtggagactttttattaaagattatacagtgttagagtttatcatagcagagtttgcataacatcaaatttctttatagtctatttatgtaccatggaggaaaaccattttaattaaaaagtgggataagctaatttatctcttgaataccaaatgtcttaacctcaaaacccaggctaaggttattcttacaaatacagaatgttttcagaggagacaaaatagtgaattcagtgaatattttgttgtacagtccattctgtattttccttctacattttatttattaagtcagacatgtatattcactttaaatgaaactcttctaatgcttgacttggctacgtttggaaatagccactcgaggttggttcatggagaaagaggtagctggccacacacagacaatgactctccctcaagtgtacacaaggtgctcacatcttcccaaagcctgcttccaggaccccaggccacagtggatgtgagagagacaggatgtcatgttgaaaggcagttttatattgctaaggctcccataacacagttaaaaccaaagatcaaatctaacctggcaaaacgttgaaaacagtttacagctgtttgttagaaaaagttaagccattaactccttagatagccttgattcccgttttctttttgtccacagctatttagtatcttttatggaagtatagaatatttatgtctgaactgcaccaaacatattcaaaaatgctatttggtgtatatataacaaaagtaaacatatgtaagatttctacctgttggcatttgtattaatttacaaacatttatgaagtagaatgctactcaaaaaaattcatttaacttcacttgttggttattggttttattaataaacatatagagaaacaaaataaatgataatatggaatattggcagagatgcacaaatatttacattctgatatatcatttggcaggaaaattttttaaagcaatttgacaaaatatatcaaaagccaaagacagttaatgtcttttgactcattaatttcacccttaattatctataccaaagaaataaaagttatagacaaatatttatgtagaaagagtcaagacagaactttaaaataataaaaaattgtttctctctaaatagcttaatgaagtgactgcttctgtgaatggtggtgcatcagcctaattcaatattatgtggtaattttaaattatgggtttaaataagttttcttaatataggaggcagtcgtataatatagctgcatttttaaaaagcaggatttgaccaccatgatcaagtaggctttatctccaggatgcaaggttgattcaacatacacaatcaataaatgtgatttatcacataaacataactaaagacaaaagccacaggattatctcaatagatgcaggaaaggcttttgataaaattcaacactcattccatttcaaaactctcaataaactaggtattgaaggaacataccttaaaataataagagctatatatgacaaacccacagccaatatcatatggaatgggcaaaagctggaagcattcaccttaaaaaccggcacaagacgaggatgccctctctcactgctcctgttcaacatactattgaaagtcctagctagagcaatcaggaaagagaaggaaataaagggcatccaaataggaagagaggaagtcaaaccagatgacatgattctatatgtagagaacttcatagtctcagcccaaaagattcttcagctgataaacaacttcagcaaagtttcaggatacaaaatcaatgtacaaaaatcactaattcctatataccaacaacagccaaactaagagccaaattagaaaggcaatcccattcacagccacaaaaagaataacatttctaaaaataccagctaaccagggaggtgaaagatctctacaacaagaattacagaacactactgaaagaaatcagggaagacacaaacaagtgaaaaaaaaaatcccaagctcatgtataggaagaatcaatatcattaaaatggtactgccaaaatcaattcacagattcagtgctatagctatcaaactacaaatgacattcttcacagaactagaaaaaaatttttgaaattcatatggaaccaaaaaaagggcctgaaagccaaagcaatcttaagcaaaaagaacaaagctggaagcatcgcgttacccaacttcaaactctactacagggttacagcaaccaaaataccatggtaatggtacaaaaacaggctcatcgtccaatggaacacaatagagagcccagaaataaggtcacacatctacaatcatcttagcattgataaagctgacaaaaacaagcagtggggaaaagactccctattcaagaaatggtgctaggataactggctgaccatatgcagaagattgaagctggacccctttcttacaacatgtacaaaaatcaactcaagaaagattaaagacgtaaaacccaaaaccataaaaaccctggaagacaacctaggcaataccatcctggacacaggaatggcaaagatttcatgaaaaagataccaaaagcaattgcaacacaagcaaaatttgacaagtggaagctaattaaacttcagagcttctgcatagcaaaagaaatgatcaacagagtaaacaacctacagaatgggagaaaatatttgaaaactatgcatctggtaaaggtctaataatcaggaacttaagcaaatttacaagaaaaaaacaaaccaccccattaaaaagtgggcaaaggacgtgaacagacacttctcaaaagaagacatatatgtggccaacaagcatataaaaaaatctcgatatcactgatcattagagaaatgcaaatcaaaaccacaatgagatatcatctcacaccagtcagaatgactttaataattttattattaaaaagtataaaaataacacatgctggagaggttgtggagaaaaaggaatgcttatacactattggtggaagtgtaaattagttcagtcattgtggaagacttgagtggggagagtcagaggagggagaggagcagaaaagacaactattgggtactgggcttaatacctgagcagtgaaataatctatacaacaaacccccataacacaagtttacctatgtaactaaaccttcacatgtaccccaaacctaaaataaaagttaaaaaaagcaggacgtttgaaaagtatatgtatacatatatgtagtattatgttgacaaggctcagaaatcatatctttttagatagaagaaaatgtgcttgttaaaatggttgcttctctcagtattacaattatgaatgatatctttctatgcttttttatacttttctgcatttttcaaaccttctgcattaagcttctattcatttgcaatcagaaaaatataatcaagaaatgtaatacaataataagatatatacatagtcttctgagacttcaaatataaaataatcttgaaatgatgaaaatctttgtcatggcatttttgagaaagggataacagatattctcttttagaaagccaggttgtgttttagagtttgaggagagaaatctgtccactggtcccttttctggcctgggaatggaatcattagttgtgttcagtttttcagacacagccatctttgttttctacttagggtgaccgactttgaaaaataatgcaaatgacatgagattctcggccaagaaaagacattggtcacttagccctgccaaggtgtcctgtctgttccatcacattctaacagggcagcagctccaggggggaggtagggcagtggctgccttctcatgggggcactggttggctgcgggaggggcctcctggccttactgctgggtgttacctgtgctgctgtgacaacagtctcatctgccaggtgcaaaatctgctctatgatgaacaatttaagtgatattccttgtggttgcataaatctagtttaaacagtattgacattttcctatactcacagttctcactttggttttgtaactgatgatgcattaataggtgttgattatagatatccatgtagataagcctatgatttctatcaagattctaaaatagacggactttgcctctagaggtttttaaaagctttttttataaagcaaccagtttaatataaatttcataaaaaaatggatcattggctgggtgtagttgttcatgcctgaaatcccagagctttgggaggccgaggtggaaggatcacttgaggccataagttaaagaccagcctgggcaacatattgaaactctgtttctaaaaaaaaaaaaattttttttttaaattaggcaggcatgctgacacatgactgtagtcttagctacttgggcagacggctgaggtgggaggatcacttgagcccaggagtttgaggttgcagtgagctatgatcttgcacaccagcctgggtgacagagagatcctgtctctaaaacaaatacaaaacaaaaagggctcatttgttttataggaggccaaaagaaatcattgcatgtcttgacttgcttagcacttattctgaagaagaaatattggcgtgaaatgcatgtttataactgggtccttcccatagtagtcttgagcacaaataccaaagttgtttttttttttttttaaaggagaagaaaaggagcagtttcaccttttttatacagaatgtagacaaaatggcagtcatttatgattgatttgttctacctacttagcatgcagggactccccagtgtggtttttaaattaattagttaatttttttctttcattagttttaatggtacaagtggtttttggttacgtggatgaatcgtgtagtggtgaagtctaggattttagtgcacgcatcacccaaatagtatacatttacccaactgctagtttttcattcctcacctccctccccacttctgagtctccaatgtccattacaccactctgaatgccttggcatacctatagcttagctcccacttataagtgagagcatgagtacctggtttttaattcctgagttacttcacttagaataacggcccccagtttcatccaagttgctataaaagtcattatatttttttttatggctgggttgcatttcatggtatatatatcacaattttttctttttgtttttttttagttgagtcttgcttttatgatttttttcctttccaactgttattttaggctcagagggtacacgtacaggttttttacatgggtaagttgtgtatgaaccacattttctttatccattcatggattgatgaggactcaggttgattccatatctttttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtacttttagtagagacggggtttcaccttgttagccaggatggtctcgatctcctgacctcgtgatccacccgcctcggcctcccaaagtgctgggattacaggcgtgaggattccatatctttacagttgtgaattgtgctgtgataaacatgtgtacaggtgtctttttgatatactgattgcttcaagaacttaggaactctggagtttgatgcatatatatttacaattgttacatcttcttgtttaattggtcattttatcattatatagtgacctttgtctttttcttgttgttttttgttttgtttttttttttttttttgctgttgttgctttgaagtccgttttatttgatatcagaatcgctactccttgtttttggcttccatttgctggaaatctctttttccaccctttacctgtagtctataagaatccttacatgttcagtggtgtttcccaaagacagcggtgtaggctgctactcacagcttctttcaaagctgtttacggtcctgtgttccttcttggaaaaaagttcacagtgtgaatctctacacactattttatctttccaagtggaaaaggaatgctaacaatgcctatattccatcatcttggaaaaacaaaacaacaagaaaaacccaatgtaaatattatcagcacagaatctttctttataggctccaaaatataccagatgcacacttcatattttatcttgattacatatgccactctttagagtctcagctaactatgactgagtaagaatgtcttagaacacaggctcccacgtccatgagtgcattaaatattcttatttccaaagtggccaggctggctgatagctatgactagttggagagaaagcagcatttatagcctaagtgggctgggcaacaaactacctgaaatccttaggagcaagaatagaagggatgccttgttctctacacccaggtatcactcattgcctgatgtctcgcttcgtgtgtttgctgggtttccgtctgtctaggaaaggaagctctatgggggcaatgactccaatgagtttgtctccctttattcctcaccatgtaggtgtggatttgagtggactccaaatggctgggccaagggccttggataccaaacacagcagaagatgcggaaaggatgagggacccaggggttctgtctttgggggaagagccctgttccctggacattgcctccttatatccctgcactagaatatcgtaaaattcccctagtcaaaacccatgatcctgcatgtcttggagaggctgcctcaaggattcctccttgactccacttattttcatggagaaggaacccctccatccctggcatccttaacagattcccttctagcttctcacccactccatctccaagccaggtttcccttcgcttctagaaataatctgcagtggctgcctaagatgttttctgcgtggaacccaaataaaaatgtaataatttaaattagaattttctacaatcatgtgttgctcatgtctgcattatggatacccaggtcacatgtaggtaagcaattagcaattatggtggaaacaagacttcctaacaggtattttggtggaaacttgaaagctgtttctaaagctgtttattcatgcaaacctcattacagtcctgacagtaaacctatgtgtgcacagggaggcaggaggctgtgaggcagcagcaggatccttcaccccatggctcactcacagtgcactctttaaccaggtcttattatgtccatgcttctggggtgattaaaatatgccctagaagccttgatacccaaaataaagcaaaacgtggaatatgaagtttaaaaatgtgaaataataagtaaaagttttgtgaaatacatttttctatactgttcaaatgatcttgaagatggcatccgtttcttaggtctgccatgcaaaatgaccacgatggagtggcttaaaacaacagacgtttcttctctcacagacatctgaaatcaagaagtcagcagggctggtgccttctggaggctctgagggcacatcagttcctcacctctcccagcctccagaggcttcctcaacccttcacactgctgagcctgtggctgcctcactccagtctctgcctccaccttcacatggcttcttttttgtgtctctgtgccttctccttttctgtctcttatatgacattcttcagtggatttaggacccaccctaatgaaggatgaccttatctagaggttcttactttctttaactctgcaaagactgtatttccaagtaaggtcatattctgagattccaggggttgggatgttgatatatttttgaaggaccacaattcaacccactaaagggatgaaaattaaactgaaaaatatcaacccctaaaaaacctgctttattgccaaccatataaattgctctttgtcacaatatacaacagaggcctcacaaaccttggtgttcttggtgtgagaatggtgaaaaacaagatagaaagcagcctgaaatatgcacaggggtgtgtcatctcgttactgggaaaggatgtactgtccaagcgacaactagactgcagaggtaaggctgagaccagggctgccatggtgtttagattgaacatgaagttagaattcttaagtatcaaaactaaattcatgttcaatctaaaccccatggctatgcctctcaaggtgaggcctctgtgttgttctctatgccttgagcacccttccttctttgcaataaaaaaagttgcagaattgactgggcacagtggctcacgcctataatcccagcactttgggaggccgaggcaggcagatcatgaggtcaggaattcgagatcagcctggccaacacagagaaaccctgtctctactaaaaataaaaaaattagccaggcgtggtggtgcacgcctataatcccagctacttgggaggctgaggcaggagaaatgcttgaacctgggaggcggaagctgcagagagcagagattgggccactgaactccagcctgggcaacagagcaagactccctcccaccccccacaccaaaaaaaaaaaagcttcagaatttcagtctcccacaacaaaacccacacacacacaaatttgtgtagcagctactatttgccaacaattagggtctacacaattaagacatcatctttaacctcaagcagtttacaatccagagggcaatgatggaggagaataatgaggtgtggataaaagtgcctattagcagagtatgcagtggaaagtgtgataacacttctagatagaaggcagttggtccataggtattttggtgagaatctacatgtctgatgcatcatgggctgtaccaaggacaagtcactgcctttggaaatgtttgactcatgccctgatggataggtggataggtctacacatcaaaaatgcatgcctggctacacatttatgagaacaacaaaaattttttaaaaattataacgccacatgctggcaaagatgtggagaaactggatctctcatgcattgctggtgggtatgtaatatggtgcagacattctggaaaactctttggcagtttctcataaaactaaacatgcacttaccatgtggtccagcaattgttctcttaagcatttatcccaaagaaatatgaatttatgttcacaaaaagttatataaaaatatccatagcagctttctttatagtagctaaattctggacaaacagcaacaacaacaacaacaaaatgaatgtttctcacaggtgaatggttgaaaaatctatggtccatccatagtttggaatgctgctattcagcaatcaaaagaaatgaactgttgacacacacaataacctagatgagtctgaagggcattacgcttagtgaaaaaaagccaacttcaaaaagttatctttataaagcattctcaaaacgataaaacagcagaggtggagaataccttagtggatactagtagacaggtacaatgggtaggatggggccaggtgcaaacacagacagataggaataaggaattcttctgtggtgtggaatagttcctcatttgatggtggtggtgggtacatggacctgtaatgggataaagttaaacggaagtatacacctacagagctacacgagcacatacacacaaatgaatgtgggttaaaaataatgaaggtggccaggtgcagtggctcatgcctgtaaacccagcactttgagaggctgaggaggatggaccacctgaggtcaggagttcgagaccagcctggccaacatggtggaaccctatctccactaaaaatacaaaaattagccaagcatggtggcacatgcctgtaatcccagctactggggaggctgaggcaggagaatcatttgaacttgggaggcagaggttgcagtgagccaagatcgtgccactgcactctagcctgggtgacagagcgagaatccatcttaaagaacaaataaatgaataaaagatgaaggcatctagtctactggataatgttaactgggaatgttcccatgtgggtttcctggctctgatattgcaccacagctatggaaattcacaacatggccagaagctaaaggacacacaggactctactatttttgcaacttcctaggagtctgtattgcaaaactttagctttgtaaaagtaaatgccaaaagatatatatgtgcaataaatgtgaatatatacattaaaaagttgtgggagtttggagaagggagagccccttgtaggggtgaggtcagggagggctccatagaggaggtaggacgtgagtttaacctggaaggtggaatgaaatccaacttgaagaactggaggtaattttcagaatggcaaaacagtgccagccagtcatacctggaaaaggaaaaccatgttctcagacctcaaaatagggaatgggggaggtggagaaacatacaaggtatgtttgagtgctggggtggaatgtctgggtaaagaaggagttagtgggtaactggaaacataggttgcagcaagattataaaacgtcttaacttttaagctgtgaaaactgagcttaatctgtaaatagcaggaagacattgtaaattgcaagtgagaggatatcatactggaagttgcatgtgaggaagctgagtctggcagagccctaggatagactggagtggaaaaggaagatgaatgagcgatgagttataatgccatttcacagcccagcacaggcatcctgattatggcttgcagtaagctgatggtcacgggcctagaggggacaagtctaatttaaatgatgctatgaaccttgaccaagaaggaccaggccactgattgccttggggacctggaatccatccaaggaggagcctgggacaggaatagggacagggagaaagcttggaaggaaaggtgccacatttcatctgtctcatgttgattgtaaggggatggtgtgccttccaaatggaagtacctggctgacctccagagatgggagacagcagctcaggagagagtggtcagggctttataagaaataatcgagacagcccaagcaggtcagatcagcaagggtaagagtggaaaagagagcagaagaggaagaacagaaatgtaggagtcttgtgtgtgcaggcatcgccatgcaacgtctatgaaatgagtagtttctcacttcatccagtcttcttcttggcattttgctcaaagcctggcattatactggacaggtccagggttggccacacaccctgcataaccttctcactcatcctcccccactgcttccttaacaacctcctgtcactcactgtcatcaaggcggaagcatgtgcacttcacttcatcaaccatggcaaccagctctgagagtcccaagtggaagacgatgaggggagaatcactcattgtcctcgtggctacaggcagcctctctgagcccacagaacctcacccctacaattaatcctgaatgcgagttctcaaaatagtgcccgctcatttagctgtcagctgtcttgctcttagagcttctgaaaagaaatcacaatagctcagacctcatctttgaggggctgtttgttttgagggctttttccttagttgcatgcttcctattgccagcaaaaatttcttaatcttcctagaggatcagattggcctgttttagatttttaaatgaaaggttaagaggagggaggagtagggcagtgaaagccgcagctgcctctccatatttctgtttcgcaacccaaggggattttgtgtagggctaaatggaaccccctacggataacagttatgtcaggagatctttctgcatgttctcgtcatactcaaaatgttccttcacatgtaagttagagaggacatgttacttctttccccagctgtttcctggtgagtaagaactcctgaccatgtgagaatatgagagcatgcagcactccaagatccttggggaaaacaatgaaagcaacagctcagtgagccattctccatgctcaaccgaaaaccctttgagattcgctgccactttctgtgacaatggaattgtggcccggtttagcccagaaatgtgttgcccaggctggagtgcaatggcgcaatctcagctcactgcagtgtctgcttcccaggctcgagctattctcatgcctcagcctcccaggtagctgggattacaggcacccaccaccacacccagctaattttttgcatttttagtagagatcaggtttcaccatgttggccaggctagtctcaaactcttgacctcaggtgatccacccacctcagcctcccaaagtgctgggattacagataagagccaccatgcctggccagtgctgctcaaatttgaaccaggaatatttgttgatgggaacatacactaaatctattactccatggattccatttttattccattgataatgtattataggtattattaggaactaacttgtgtctccccctaaaattcgcatgttgaagccgcaactcctgctgtgactgtatttgaagatagaggcttaaagaggtgattaaggtaaaattaggtcctaagggtagttctcatctaatctgactggtgtccttctaagaagaggttagcgtgtagccacacacatggaggagtgaccgtgtgaggaccccaggtgaagatggttatctgcaagccacggagagaggcctcaggaggaatcaaccctgtcaacaacttggtcttggacctcgagcctccaggactgtgagataataaagtcctattattgaggccaatccatgataatttattatggcagacctagcaaatgaacacagatctatctttctgagactttacattatagtttttgtgttttaggggctgaataatatgccacttatagatgtgtaattactttttaagtaactgtgaacatttatgttgtgcctaaaggctcctataatcaataagattgcaatgagccatccttatacataaactatgcacatttatctaattaatttcctaggataaaatacaagaaaaggaattacagggtcaaaagatctgctcacacaacatatttttacacctggccaaactggcttcccagaagactgtaccatcagacatttccattgcaagactagagtgccagcaccccagtccccacctcctaccaaactggacactttcagtcatctgctctgcaatggcaagaaaatttcacagaaattaaagaaattatagaaagaatttgaatatcttggtattttaatattgaaatttccatttgtttaatgaattctctatcctttttcactttttctgggattgtttttagtatttataaatttatgttattgcataataatacttttttactatagttacaattttttttcggtttgactttttaaaaattttgttttccatatttatttgtttgcatgtttattgccatacagaatctttagcaggatgcattgtcaaatctgctaagcactatctttgtggtttctatcctggggtatcatgcatgcaatgtctttcttttcttgaaatggaaaataaatcacctaaattttctttaaattgtttttgttttgttttgagacaaagtcttgttctgctgcccaggctggaatgcagtggcatgaacagagttcactgcagccttgacctgttgggcccaaggggtcctcccacctcagtcccccagctagctgggactacagtcatgtgctaccatgctcagttatttattattttatttttgtagagatggggtcttgctatgttgcccaggcttcttttgaacatttttttttttttttggcaaatcccaggaaaagcaaggattagaaatgtttactaccacattattgggatttttaaaaaataaaagcagagttttaacttacttgatataacacatccaaatagctatgtggaaatggcccaggaaatatggttgatgctggaggcacccattcctctcactgggtctcaatgtgtgccctcctccaccacctacccagctgtaccattgtacctcaggaacatgtagaatgtgcagcctctggagtcccccctagacccactgagtcagctccacaggtcgggcctacccccgtgtgctaacatgccctccagaggatgctcacagcctctgctctgctacccagagctgcctccttgacccctggcctcaggtgcttttccccagcagtttccagtggattcatcctcacatcctgttcctgtcattagggacacacctactgggatgaaggtattctggtgacagctcatttgctattcacacaggcacacacagactcacacgggtgttcaaaggtctctttacctagacgcactgacattactatccttagaactgggtggagttcagagagatacagttagagcacaggttacacgttgtgtcagatttcacagttccctctgctttgggcatcccaggctctctaagaggaagcaggtgctgctgccaatgccaaaaagcctctgtgggtgagatagttccatgtcgaatataaaaggccaaatgtggtaaaacctccaatacttattgcataaatcctccctaaatgggatggagagagcagtgcaacaatctttcttcaggagaaactataggtgatgcttttaaacattatttactatccttgaatgtttttgaaacatgcttaaatatcttatatgcctgttttatatgtgcatatggggaaatatacaatataatattcaccgaggcaaagaattggggacatgatcaaggagatatttttaatacttcaacagatcattttttgtggctctttagcttgggaccttgtgctgtgagaggcacaagtttctgtgttcaagagaacacttttttttttttttttttttgagatagagtcttgctctgtcacccaagctggagtgcaatggtgcaatctcagctcactgcaacctccatctcccgggtttaagcgattctcctgcctcagcctcctgagtagctgggattacaggctaccatcaccatgcccagttaatttttgtatttttagtagagatggggttttgccatgttggccggtctggtctcgaactcctgacctcagatgatctgcctgccttggcctcccaaagtgctgggattacaggcatgagccactgcaccaggcccaagagtacacttacttgcatgaaggagcagtgaatgaaacctgctaaggcccccagcatgcactgcttggcagcactcatcttccttggagctgaatcttctagcaggtttctgcttcatttagagccgtcaatacctcaattagtgtctgttcgtctcccctgggagggacctttacacatgtctcttcatgagcctctgaactttaaaaaccccctgagagttgctgggtcataaaatacctcctgattaacagtgctgtttgccaacaattccttgctccttccatttcccccttcttaaagatgtatcaactgacataaacagaagacacagaaggggtgcagcctgccaacagttacatggaatgtattcctgcaaatgtgccatgcatctgtttacccatttcactgctggatgcagggctcataagcccataacacaaagcaggaaaaagcactggttttagttgcacatgtgactgtgtgtgtgcatgtgcagacacacttgcttgtgttggcatttactcgaaagctaggatacgacctccatctctttgtatcattaatactacagttcagttacatgagaagaatctcgcccccactttgaattatgaaagtaaaggcgctggttctggcttccacaggctgggtgtattccttattctttcagaagaggtgcttttctatctgcaaaaccattggtgttattttgtatctccatagcctctctaagtcagttgtcccttccacaaacctataaaataggccaaggttatagagaccatctgagaactttaaggttttcctttatgagaacgttcttaaataagtaagaaatatatagttgtatatttattttctaataaacataataaaaatgcatcatcttggctttcacacaaaatttgggagaaaggtttcaagataattaaaagtctttaggagccattgccctctagtcttccagcagacacccaggcaggtatgaacataaacacacatccacatccacgcaaacacatgcacacaggcacacacaaaagaatgaatgtacatgcatagaattgcacacgtgctcacacaggcacattcatgggtacatgtgtgtgcacacacgcacacaaatatgggccctacaattaatctgtagcagcaatctctttgaaaacaccactgggaaccctattcttggaaagtaagcagaccatcaccccattctcttcaaaacaagttaacaaaagttagcacttaaaacacccctgttttccttttatcttttacctatgttgttaatattctacgtgatatgatggacacaaccgttatattatttatcaaattcattaatatttcatttaaaacctacataagtgaaatttacttttaaacatattttatttattgctcaacctttataaaaaccacattaaatatttaaaatttttaaatctgtatgatcccattatcttaacactttttttcttacaatccttgcctatacatatatatgaaaagctctttagccgtacaggaatgtacaatgtaattagaaaaccaagtcatgaacacaaatattaactagaaaaaaaactaaccttataagcactttataatctacaaaggtctttgcatgtatttaattgtgttgcttctctctattgaggtgggcatcacccttgcacccatttgatagatgattcagaacataaatacccacctaattttatagcttatcaattggcagagccaaaaaacctcaaagttagctctgctgattccaaagcctgagctgcttctgcaatatgcacgcagggtactagaaaacaaggctctgggtgacgggtaggggagggatgccacaaagaacagatgtaaagcagcccccaggtgggggatgattcagacaggttgtgggaccccagagtgtgcatttctagcatgttcccaggtgatgctggttcagggctgtataataactctgtgtataaaaggaaagaaacaacaggtactatacatgtatggtagatatctgcaaacataaggtggaaggaaagaagccagacacaaatgaatgcagaaaggttgatggtattttacatacagttcaaaagcagccaaggatgtaccaagttgttcatgcatccatacccaggtgggaaacagatgggctgcatggtttaaaattctggctccgctcctctctacctgtgtgatcttgaacaagccatttagcctctctgtgcctcaatttttatactcatatttacaaaacctccttcctaggattgctgtaggtattaaaagctaatacatttctcagcagagaacttaatgcatattagctataattatcatcctcattattacaccagatgtttttaaaagggcatttatgtccttgatactagcatagtcaaatgaaaaaggaatgaaataaatgatacaatccagataaccaaataaaaaaaccatatgggcatcacatgcaagccaatggaatcatgccactaatgcttgaatgaagaggcacagtggaaaatgaatattaacacagatgaagatcacatggtcagagtggtttcaaggaaaaggtgaaactttaggaatcagaaatatggtggagattataacgttgaaggaaggatcaaaatactgggcgttggcccattttggacaagaatcttcaggtagaggagatccctgggacaccctaaagagctattagcttgtaatctctacagcaaccctaggagggggtgctgtaattataggtacagaaattgaggcacagagaggccgaaggacttgttcaaggagataaccagcccagcttccagaagacacagcacactgaacggctgggagccacaggcagtgtgctgtgcagtgggtgatggagacaagacatggtagaattcaccaccccattgagtgctaatggggatgatgatttatcttctctgtttctccatgaaaaacagctgtacataaagcagctgctcaaaagttagaacatggcttcagacatgacaactctgtgtctgtccccaagccacatggaaactgcttgccttctgggaaatgcatctgaatataagagtgaagggtggcgggggtggaatccaccccccagctcccacacagggttgttggcaggctattggcccaagacttgtccttctcatggtcctctccataggccacatgggtatcctggtgatatcatggcaggcttccctggagcaagtgatcagacagaaagagagagaactggggcacccaagtagaaggtagaagctacagtccttttataatctggtctcagagtgataaaatgtggagagtttgaattccaggagatgagattaccacaggtcaccttaaaaactggctaacccatggctcataatatatttttgctgcaattaatatcctggacagcacttacccaatttttcaggatgacatgatctattttcttccttgtttctttatttttttactatcattgatggcaggaaatcaaaatctatttactattttcctttttctacataattattaagaagttttctgctgagtacaatggctcatgcttataatcccagcaatttgggaggccgaagcaggcggatcacctgagattgggagtttgaaaccaacctgaccaacatggagaaaccccgtctctactaaaaatacaaaatcagccaggcatggtggagcatgcctgtaatcccagctacttgggaagctgaggcaggagaattgcttgaaccagggaggcagaggttgcagcgagctgagatcatgccactgcactccagcttggtcaacaagagtgaaactccgtctaataaataaataaataagaagctttcttattgggcaaaatatagtacctatgtacagaaccagacagatggaaaaaaaaaaagaaagaaatggccagcctgcctccatgcgagttagaggaaaatactgtttttgatatcttttggttaatattcatacttgtcttaaaaaataaatcaactttcttccaataatgtgacttgaaataacttcagagtgaatgtaatatgaaccctaaatgttcttcgtctttcccctgacacattcaatcatgtcataagggcctggaaaagctgccaggaagtggagatgttgtcattcttgttcaagcttagcatcaaatatgacccactccagcttggaaacatgaatttgattaacggttataatctaagtaacttcattatgtaagcataataacccagctgaggagatattttagtatgtgctaagaatttgttaattcctggctggaaaaatcattttctttataaggattagagctgcccagtaggcagcctcacttgccgaaatcttatgaacaataagtatttggacaggagaaatttttgattctgcagcagggataatcacacttggtgtttctgtggggccattcttccaacaccctcagagggttcctctaacataatctcattaatcctcattacagccttaggaggcggcaggtctcattgttcttacagatgaggaaacggagatgaaactgagaggcagagaccacaaacagggaaaatactgcttggcctttgaatggcttgagaagaaacaggcaaaaagactcaagccattttctctagcaaagttctacagactctaaaaaataatgttttgtacaccagtgttcacaatagccaaaaggtgaaagcaacacaagtgtccgttgacagatgactggattaaaaaaatgctgtgtacacatatcttgaaatataattcaggcttagaaaagaaggaaattcagacacaggctacagcttgactgaaccttgaggagattatgctaagtaaaatgagccagatacaaaaagacaaatactgtatgattcttcttataggaggtccccagagaagtcaaattcatagagacggaaagtagaatggtgactgccagggcctgggggccaggaaaaggagagaatagggattgtttaagagttgccaagtttcaggttgggaagaagaaaaagtttgggggatgaattgtagtgaaggctgtacagcaatgtgccttgcagctgagaaaatggaaatttcaaggactttatggggagtctcctgtaaatggactcaggccccagaatgaggggcttccaagggtgttctgatttgaagacagactaagaatgtactttgtccactgaaagtgaccaaaatgaccaattttttgttatgtgtattttaccaaaaaaaaaaaaaaaagaatcctgaggacagcaagtattcgctgtgactgggaagatactactgtgggtgttttttgttttttgtttttttaattttactttaagttccagaatacatgtgcagaatgtgcaggtttgttacataggtatatatgtgccatggtggtttgctgcacccatcaacctgtcatctaggttttaagccctgcatgcattagatatttgtcctaatgctctccctccccttgccccacccaccgacaggccccggtgcgtgttgttcccctccctgtgtccacgtattctcattgatcaactcccacttataagtgagaatagtcagaatggctattattaaaaagtcaggaacaacatatgctggcgaggctgtggagaaataggaatgcttttacactgtgggtgggagtgtaaattagttcaaccattgtggaaaacagtgtggtgattcctcaaggatctaaaaccagaaataccatttgacccagcaatcccattactggttatatacccaaaggattataactcattctacaataaagacacatgcacacttatgtttattgctgcagtatttacaatagcaaagacttggaaacaacccaaatgcccattaatgatagactggataaagaaaatgtggcatgtatacatgatggaatactatgcagccataaaaaagaatgagatcttatcctttccaggggatgaagctggaagtcatcattctcagcatactgtgggtgtttttatggctcccaggtgatgtaaggaatagggaccacaggtttaatgaaagataatcgtgatgtattgagtggcttgggaagatgttgattgcaagtggattagtcacttccctcattaaggcttgcctctgtacccattgccttcatgatgggcagagtgggctccctacttcagattccagattgtggttactcatatctaagtcttatccaagagactgccctctcctcagctcttcttattcccctcctgctcaaggtacctgggctgtttctttctactggaagcagtagaggctgcctaggaagtggagtactgtcctgacattcagggacagcatcatcggtacaagaccagtccagtcccacaagccaaagattatctgcagccgccatcttgaattcttaacaattttgtctttgaaattgtgttttgcaagtgaagtccagtgtgacaatggagcatgaacagggtatgtggagccacagctcccatgtcatcccacctcccactgcctctccagaataggttttcagctgttcactttcctgccccctggagccccaggctcccctttcctgcaactgcccagcaatggctatggtcatccagtccatggggatctgggtaagtatgtggagaaggtcagagacagcctcctgtaacatttctgggtgtggcacccctccctgcttctaggtggcagtaccagagagtttacagaggatgaccgggcagggtgggtctccaggtcactgaaggtcacctattcgactgagagaggcctgactacacgtccccaccctggcctgggtatgatgatggtggggatccaggcatgtggtggggcacatgagtgtgcatgccaagtcacagggctgttactgggagttagggagggtcagcacttgaccagccagtatcaccatgccagaggaagtgggatattaaataaaaaataaaggccatcatgacagagggagagagggagaccacagaaggaaggaaaaagctttatattttagaactttaatggcacctttttcctgctttttgaacaaaagcctccatattttcattttgctctgggtcctgcaaattgtgtagccagtctcgtctgcttaattctacaaatatgcaataggcttgcgggagatgtttgggtcttgccttgcagctgagaaagtggaaatttcaaggactttatgaggagtctcctgtaaatggactcaggccccagactgaggggcttccaagggtgttcaggcttgaagacagtcaggctgtcagatacccctgtggtcagacactctgcacccttggcctcctccgctactataagggaaagaggctttgcacttggaatcagaagacctggattctccttctagatcttccatttactagttgtatgactttaggctaattacttagtttccccatcctaggtaattataggtaaatggaattaagaatcccttctccactgagaaacacatgtgttgctgcaagctcatgatatgaaaatgatctgagacgtgaaaggacagaaggacagatgcgttattaactaactgtgctgctactaccatttagctttccagaccctggaggaaggaaggaggaaagagaagggaagagaggggatgggaaagattcatcactttagggattaatgaagatcattttactgtattacttttatggtaatattgattttttaataaacttactaaataaaatagaactttgcattagggataggagagaggcaaggggaataggtctagtcatttccagtcttaaaccccctagttctctgtttccttacttagaaattaaggagaggctgggcgcggtggctcacgcctgtaatcccagcactttgggaggccgaggtgggtggatcgcaaggtcaggagatcgagaccatcctggctaacaaggtgaaaccctctctctactaaaaatacaaaaaattagctgggcgtggttgtgggcgcctgtagtcccagctactcgggaggctgaggcaggagaatggtgtgaacccgggaggcggagcttgcagtgagccaagattgcgacactgcactccagcctgggccacagagcaagactccgtctcaaaaaagaaaaaaagaaagaaagaaagaaattaaggagaaaggggagaagatgtcaagtagaaattaattccaaaattctcttatattctaatctttatttttgcccatttaaaggcggtgtttggtgtctggtttctatttgaccatctgcatagacctttgttaatatagatgcaaatccaattaatctgctggaaatgttttgtctatgtgtctcacttctatttatagcataatttagaatcaacttaaaatagtactcatgtgtcttgggtcatttccatggctagtgtttttattccatcatgtcgtatggctgaaatacttatgcagtatatggaaaagttcttagcacacagtcaacactcataaaaattagctattgttgttattatggcactgtgaaggagaaaacagaaaaaagcaggagacagaaatagagggaggatgaaacagaagaaagagaggggaaagtgaagaaggaaggaagggaaaaatgaagaaaaaattgggagggaggaacagaaggatagagggaaagaaataaagaaaaaaggagaaggaggggaaatggcaattagtgggggaaaagaccttggggatcatcggattgagttgtttcaatccaggctgtatattttaggatcgtctgggaaacttaaataaatccatgcataacccccacccccagggactctgagccaacgtgcggtggggcctgagcactggcctattttaaaggcttctaggtgattccgagatacaggccaggttgagagcccgtgatcccattcagctcctctatgactcaggtgagaaagccaaaacccaggacggccaagggtcctgcccagtcccagcggcaggaggttggagtcagattctctgctcccaggccccttcctcacctttccttttggtaagacatatgtgaggggcaccactctaccccaggcaccacctaaccccacatcacctctgcaggccagggtgcggcagttcctttacctgggacaccaggaggccagtgggtctgcaccctgagctgcagaatccaggcaggtggctgccatcttacagctcgacctttgagacccacgctgatgtatgtgtttacccaaggtagttttaaaatagaataataaaaaaaatgtattcagtaaatcttgataacaaagaaaacacattttgattcaacactgtgcattaaagtgtgaactgtggaatccaggcagtagatacatggctgattggcttcctgtatgtttgaaattttttcataataaaaatttgggaggactggtttaaaagggacttgaaaaaatagctttaaaatgtgtttatgtcccagagcatctccttcttttgacctcccacccgggaaccctgtaattcctgcctcagtttcccatcttgggcattgggccaggtttatgctgcctcgttcttggctccacaccctcctctgccatatctgctctgaatgcctggagggactgagaaacttcccaggatacagacttcctgtgttaaaacactggaagtcctggacaccctgggacagttggccatctcctatgtttggggtgatcatgacgatgatggttttcaaataggaccgatcagagtcagatcctgatggactcctgtatttgggcatttgacaccctttcttctctataaaatgaaagtattgagccagatgcttgtgacaggaatcttgtctcattcgggattatccaggctgtttggtactttctcctgttttcttttcagttgttttcttttcaatctgttttcttttcagcagaaccaggtaggaacaaaaaccataaaaatgtataaggattaattttgcattattgatagagtcattaaaagacttgagagtaaagtttggaaccagtctttaatatcagtgatttattgatagaatttttcattctctctgtatcctagggttaaaaaattaagatattcatcaatttatcactgaattacttgtcaaaacgtacagtgacaaactgttcatattttaattatttaattaataaataagggtttactttcattgataaagttaattattgctcttagcttaatcttactatcttctcagtatctcttgtacgatgggaacaccctttaaaattattaatatagtgaaacactctcctaagtattattctggtaaatgtttaacaattagctattgagggggagaggatggagaaagccgtgatttctagcactcgccaatttcagtggtataaatactaccaccattgccaatttcaagctaaatgggaaagagacatgactgcactgccaagctgggcagagatgtgcacaatcagatctccctggccaatgacagcagctccactacaccactgcatctttatgctgcaaaaaagtaggtcagagggatgctcccttatatcataagaacacagatttactgagcattaaggatgctgttagataatattatagtttatgaagcaaatttataaattgatatgatgtaaaacagcaccttcctcaatgggtaattttgcaagagaggcacgcagcacacaacctttggacaaagccttcttgggtctggatctcccttggccctgctagcagggtttgcccacagcctctccttggtaccaatccctgttaaattaccccatccatttgttatgcttcagaaatcctcgcaaaaagggctgctgtacagacatgttgtcatctctaggcatccataactgtgacaagtgaaaaggtcatgccttcaaacattagcattgcaaagaagccatggtaatgattcattttttcctttccaccattactttaaagggctgaaaatacttgagctggataggagaacatgggctagtcagagcatttctctctaagtgctgaatttaataaccagaacaaaaatacccattttagtagggcactctttcaaagtagaaatctaaataaaactgaggagtattgtgtgcagattaagatgggcaagtcataaacaaaccagaggtctatggtttggccaaggtacttctctcatcaaatgcgataaaacttgtgattatttttttaaaaaaggaaaagagaagaaaacaaacaagtcctcaaaacaatgctgcagtttttggagaacagttcttccagttggtggttttaaagtactagggaattacattctgggtcaacaccagccttggagctcctagaataggacagaaacccttacttcagaattggcttgctctcattggaatatagtcagtgagtgttaaactaccctggatttgggaggtgatgatggtgacttaccaagttctcaaaggaaaactgtctgtttttatgtcttaccattttatacatttcctttttacaaacactgcaaaataggaaatcctgaccatagccttgagatgcccaggagactgggaggcattaaacatggattgattttcagttttgcaacaagagtttctatattttattctaaggatgagggtgttgcaggaatcaggacactcatcaggaattggggcgtgggggttgatggtagtggacaggggtcacctttcaaagctaaattatatgtgggtgtcatggtttctgattcacattccccagtcgtgagagaaagaatgaggagtaaatattttcttgttcataggcctgtaatttatttattcacagttttgtaatttaggttacttttgttggctttgagatctctaattatcttgagttagcctctttcccgtatgagaaaaaatcttgattagtggattgaggccaaacagaaagtgccaccaccttcagttcctctgtgatggcagatccatggtgagcctggggtttctacagccagtaagcctccagctgtcgaggaacatgccagctcacctttttataggtgcacccaatctctactctttgagttcccctgttgaattcaaatggttgaacttaaattgttgaactcaaatggttgaaagggaatgttcttgttccctcaccataaatgctgaatcttaacacctcctcttattccctcttctctctccaatctccggccacaagagtgcaaaatggtgctgccacttggtcaaacagtgtggcagtttctcaaaatgttaaacatgaaattgccatataacccagtagttccacttctaggaatctctcctggaaaaaaatgaaaacatttgttcacacaacagcttatacaggaatatttatagtataattactcataatagccccaaagtagaaacaaccccagtgtgcatcagtgggtgagtggatttaaaaaaatgcagtatatccgtgtgctgcaatatcatttagcaataaaaaggaacaaagtactgtgctatgacatggatgaaccttgacaacattatgcttagtgaaaaaaatccagaaagctagatactaaagaatacatgctatatgattccatttataaaaaatgatctaaaaaggtaatacgggtattgtgttagtctgttcttttaaagacataccagagactgggtaatttataaaggaaggaggcttaactgagtcacagtcctatgcgactagggaagcctcaggaaacttacaatcatggtgaaaggggaagcaaacatatgcttcttcacatggcggcaggaaggggaagtgcagagtaaagggcggaaagcccctcataaaaccattagctcttgtgagacctcactcactatcacgagaccagcatggaggtaaccacccctatgattcaattatctcccaccaggcctctcccatgacactatgggagacgaattgtatttatggaaactacaattcaagatgagagttgggtggggacacagccaaaccatatcagggagagaaggtagattagtgattgcttagaacttgagggggaaaagagaaatgactgcaaatgggcaggagaaatcttttggggtaatgtaaatgctttaagatttgattcagtgatgattatacaactgtgtatatttgtatacaggttataatggtatatatgtatatgtactggataatataaatatatttgtaatgggttgaatagtatccccaaaaattaatgtccccttagaaccttggaatatgaccttatatggaaatagagtctttgcaaatataattcgttaagaagagatcatactgcattagggtaggtcctaaatccagtgactggtatcctcataagaagtccatgtgaaaagacacagaaacattcaaagaagaatgtaaattatgtgaagataaggcagaagctgaagttttgccgccacaagccaaggaatgcctggggccaccagaagctggaagaggcaaggaagggtcttcctctagagctcttagagggagcatggctctgttgtcgacttgattttggaattccagcctccagaactgtgagagaagaaatttctgttattataagccacatagattctagtaatttgttacaggcactctaggaagcgaatgcaatattaagtgtacaactgaattgcacacttaaaacaggtgaattttatggtatggatattataccacaataaagctattaataaaaataaacatttttatttattttataggctaggggaagggggggatcagaaccaaaggctggggacagtacagccagttttgctgcatctcagaaatgccagaaaaggaatttcacaacagttgtgagcaactgtccttgatatgcaggactcttggcacctctttcttgagtcaccaatttgcctactttccatcttattacacggtcagtgctgtggggcacatctctgccacatggctgctgactctagagaaactcccaaatgtaggttcttctgtgggtgttcaggctacggaactggtagtattttgacgtttcattatatgtctcaaacctctctagtaagccatgggaaaagacatgacccagtatgtgccagtcttagaagaagccacagtgtttctatggtcaagtaccttggaagtcttacgaggcaagcaatcaagtacgtagtctgagcttgacctcagaaatgggggaagggagcttcttcctgtgattggggaaatgagataaaaagcaaataaaaaggttgttatgttttgatgaattttcaaacctttctagtcctttttgttaacatcttgttcctttatcatatttttaaaatatctttaaacattcttgcatagttattttgcagtctgtatctgacaactgtatcatctgaagtcctgggaggctggttctcaatcatggtgttagttttctcatgtgttctttagtttcagtttgtgagctcacggccagcagggctttatctgggtgcatttcagtgggcctggacagaggacacattcttctagagtatgttagcttttgctaggctcctcaggccattatcaaattacggtcaccttcatgttaaagctttagcatgaatttgactacagacctatgtagagtcaggccagttttataaattctcaggggagagattgtttttctacatatataacacaagctgaggcagctttcttctctctttgcctttgtggatttttatttattgttattattattttggttatatactttctgtcaagatagaaccctttgaggagcctggctttggaggtctcatatttaatgtcatgcctctcaggtagtcaaagcaccgccattatatattacctctggcttttcactatcagcttttgtgtttggtctctggtttttctctcactttctgataagcttagtatgcattttaaaaggtgtttgtcatatgcagtctacaatttataagtggcttgtggaattggggtgggatcttttgtcatctattgccaagaaaagaagtctatgtattagacttcttttaattttgatgtgggaaaaggaaacttgagaagcttcacaaataaagggttcccttttctcagtaaattggagacgagattctctgctataagttatggaagaaggacaggtttgaggtctccagtgactgataaaggtttgcaaggtttataacaactgtgggagatgggcattgtgaaaagtggttacaaggactggttagcagcaacaagggattcacctaaagttgactaaaagtggaagttttatccccattgtttataatgatagttagaaaccagtaacatcattgtattagtccgttttcatgctgctgatacagacatgcctgagactgggctgtttacaaaagaaagaggtttaatggacttacagttccatgtggctggggaggcctcatgaccatgatggaaggcgaggaggagcaagtcacatcctacatggttggcagcaggcaaagagagagcacttgtgcagagaaaatcccatttttaaaaccatcagatctcataagacttactcactatcatgagaacagcatgggaaagatccgcctccatgactcaattaccccccaccaggttcctcccatgaaacatgggaatgaattatgggcatacaattccagatgagatttgggtggggacacagccaacccatatcaatcattctgggtgtgctaagggacataggccatagccctcaacagggttggaagagcaacgtgccgtggatatgaaacggcatggcaatttctgctgagggctcacttactcaagtttcatttttctggtgcctttcctttattttgctcgagattctcatgcagcagtttcttgaataaatttcattttgaagaaatatctcttgaagcatggtttacctgagtgttttgccagggaaaatcaagaaccctgctttgctgaacaagttgtgtcccttttgctttttcagttcctgcgatgataacatcctatccaaatactaccctggccacgcaggggcagaaaaaggagatgagctgcacggcgcatggtgagaagcccattatagtccgctgggagaaggaggaccgaatcattaaccctgagatggcccgttatcttgtgtccaccaaggaggtgggagaagaggtgatttctactctgcaggtaaaagcatggcaaatacaacacaatggaatgaactttattggaagaataagtctttcctttcacagaagcgggtgcagataagtagcagataatctttcggaatttatttacgaagcactatttctctcccctttcacacagcgagattagtgaagtagccttcaaaaatagtgcttcagcctaagtgttattaagaatagggttattatgaacgcagcagggaacccaaatgtagtaaaaaaaaaaaaaaaaagtgagaaataaggtttttaaatgacagttaatccttcaggaatgatggcctatgctgtgtgcatgttttaacttcctgcaaaaagaaaaatgagatgggctttgggacaaaaatattatcataaaaactatcttgcttctttggaaaaatccacaataaaaaaaaaatctgtcgttaaaagaggatcacaaaagctagagaaaaggactgtgagcagtgaactggtttgtgctgttgtcatgcggttggaggatgatactgtagcacacacagggtggggaggtggggaagccctgtgtttgaaatgcttatattggctctcagacaagggtccattcctggaatcctcctagaaaaggaatctgatgcgagtcttgcgggcccccagccctgcctgcagtatttaatctgtctctttaggcatggttgctttggataccatgaaaaaaaaaatgtatatgtgggatatatgtcaagctgaccacgacatcttatataaattacacatccaatttaatgagctacacctgacatggataatgtacgtgaatcctatccatccgcctactttcaattacactgaaataatttgtcctcagagggatacgtgcatgtgtgtgatttagtatgtgagtctggaggaatgggggttttgtgagtgtgtgtgtgtgtgtgtgagtgtacctatgtgtgtgcttggcatggcaggagaactgaaagagtggagagagagagctttacggctcaaagtcattttgcctactgaaaaagatgaatttctttctgctttacacatagattttgccaactgtgagagaagattctggtttcttttcctgccatgctattaattcttatggggaggaccgtggaataattcagctcacagtgcaaggtaggaagacgatagcgtaagagaataaacacagtcatttcaggatgggagctgtatgctcagcctcaggcatctctgtgtcctcaacttgccatgtaacacttcctaattcccaggaaattttgaatatgtataatgtcagtgctaaagcagaattttgcagtgcctgggattatgtcaaagtaaagcccccaaacagggaacgaagcccttagaggaaccagtcaagatgacaagcccatgacagtcaagccacatgcacacaagtacagcggtggaatttctttgctcaattttaggaatccatgtactagatgaccagaatgaaagggaagtttaacatttggggccaaaatatgttttgagttagagatccaaactagaatcgtgacattttatatcctccaggcttggtccagttcttaagggctatgaaaattggaagtcttgggaaagtggaatttctcttccctaaaatgtgattaggaaaaagaaaatgcttccaaataaaaagcttctgttcttgtctaatgcagacaaatcgtttgtgagtcacgctcagcatttccactagcgttttatgtcagagctctgtttgaactaactcgtagtctttctgttgatggcacagagcccccagaccctcccgaaattgagatcaaagatgtcaaagcacgcacaattacgctcaggtggaccatggggtttgatggaaacagtcccatcacaggctacgatattgaatgcaaaaataaatcaggtaagttctttacttcctccagcttcccttccacctcagaaagttcttttatttttctccttattaatgtgttttacctgtaagcgcacagctcagctcacaggagctcagagggcaccacttcccccagtctccttgctggaagcacatcctggctttctgctgtgggagtggagtttcgtgttgaggctcagctctgcttctttcttttttagccagcccagacttcagtcttgcttcctgctggactccttgatattgcagcttcctgttggcatgtgggcagtggctgatggagacaggcccccaccatgaccttttctatttcacctgctcccttcacttcccgtttcccgagctgggtgacttttgtagagcctgagcccatgtcctgcacccagagcgttgagctcaagctgtgcttggtgttggtcggataaactgtgcagtggtggttggtgcagaaaaaggaaaattcactctggagcaacctcctggaaatgctcagggaccatcggcgacactggctgctgcacccaggaccactcggcccagagcccataaataaaactgaccctgctgccagggccgctgcaggtgtgcccattcattgccttcaaggaacaatgcccgggccattttgaactttatgatgcattgggcgagggtagaataccaccacagtggcctctagtcagaatttttactgtgtctcataaaagatatgaggaattcgagcaccaccagcatgggaagggttaataaaatccttctaggccgcaaaagcagctttatttttcacttcctggataccgcacgttatttcagattacccagttgtgacccatctaatatctttggcactaaagctgtagtaaaaaatcaagctcaaggcagctgggaaccacaggtcaggagtgaggaaatgtttcagcaagagcaagccaggaacagagccaggaaatggtgactgcaaaggcaagccgaggggtgactcttcgggaattcaggagaacagaatttgaagattgagaagatatggatcaaaacaaaaaatagtgttttgaaaagtagtatctgtgactgctgggttggaaatgcacatgaggaaagatggaatggctcaggtcatcggcctctgagttgcaactgggggcctagaagtgaggtgtcacttacacaaagtctgaggaagggccttccggggttgattggactgcaagtctcaccgtagccaagaaatgctgcagagccagggccctgggctcaggggtgaggcacagtgacctggggggctcacccaagacagtgctgagctgaacaagcatcttttggggactaggaccaacaggtttcccaagggcccagggaggagaggctgaccttgcctttcttacaagttcatgtatacaggtcttgaagtgaagcaaatgcttcttaggtgaggcaggcacatttgagcagaaactgtcctggaacttagtgacagtgatgagagctcagacagatgcagtgagcaccgtggggacagggacagccctttatctcactggctgcgcactggctatggggctgcaggctgcccatgctgttggtgcgggagcacacaggagacctctcctactggagcagcccaggacctcccctgtcctcatggaggagcgggcattgccggatgctggtggcaggcctgggctcagtgatttgggacccagcctgtgtgggattcgctgctgggcctgcgttgcaccagctctgcaccctcgcttgcgcatctcacctgtgaagtgggcactgctgcatccacctcaaaggactggcaaggagaccacaaaggccaccagctgccctctgcctggagtcctcccttccctgagccacccagttactaccccctccatagatctcaattctcaggtgctcacccagctccttctccctttcaatctgggcaggtggcattatgggtcactatatatgtatctctatgattactgacaaatatgctgattaatgcatttcacctccaccacgctagaggctccttgggggctccctgcacctagtaggtctattttcacccagctcatttctccaacacccagcaccgcacccaacatgtggagacactcaatggaaattggtgaactctaagaagggaagacattgaaaacgccttcctcgttgtctggagcatactcaacatctaataggtggtagcttgtagattgctccagcatgcaggaaaatacttaggagtaaaatgcctctaaaaccctctgtgttaaactacttactcagcatctaagtgtcctcactatctccctactcttacccaggagtttcccaaaggcagggactctggttctctgtgtcctgggatccccagcacccagcacaatgtcaagtgaagagcatactgtaaatgtttattgcattaatttacatgcaattgaaatctaagaatcattattatcaacagcatctttaaatgtataaattgatcatggtttatataaccaaagcaggaaagctccttgtctataaagctgagtacaggcgggattgagggatactcttttccatccttcatgccctacttcaaccagagacagggccagtggtgtggctaagatgtttatgtagccctggagcaagtcattttaaggggcagcatgggtcccaggagaaaagcccacaggacaagcagatccaagtccatgaccaaggtctctaccaggaccctacagaacttcaattactttcagtttggaagccctgggaggaaggagctgtgctgagagtagatagcacctgtactcactgctgtacgagttgtgttagtcagatttttcatgtattagtttcttcctccagaaatttttggtgtataaaaattacaaccataatttaagtgagtgtagttttagactgagtacatagaaaactgatccttcaagtattaataacagcctaaatgtcacttcttccaggaagccttccctgactacctattccccttcactattcatagcatgtcttggaacacttggtgggcttgtgactattaatttactatctgcaccccactgaacagttgtccccctatgggccatagtgagccctgagggctggaattgtctctgacaaaccttatgctatgtccctgtgcccctcatagtgcctgacatgtatacgagactcataataaccattagtcaaattgttgactctcaacatctgttttaggcaacggtgaaattatccccccaaaagttttcctttccttttcattaattttcaaagaaagcagcatataaccaatgtattaaagtacttcacattcgtaacagaaagaacttctgcaagtgaccattcactctatgcttgaacaatccgagaaacagaaactcactaacccagggagcacagctctgcctttggccagctgtgactgctacaagttcttacatttattgcaccaaaatagaccttcctggatccagtgtctctcctcccacctcttaaccctttggccaaatgacagtcctcccaggatttgacaacagatgactttccttggtttactcttttccaggaaacactgaacaccccaagtccttgttattgtatctcctgtcatcatctcctgcccccctaactctggtcatgcccagtggcagcaccagaggcgtcatctgagcgggcacaggcacagtgaagctgtcccttccttatctggaacattcttcttctcccataggtggcaattacacaggttgccttggttgccatattttctgattcccagggactactgcttctcccctacaaggacccaaggccacctttaacatcccttcgagcatattgtctggggacctccagcagattcgtctgcagtttgttgcctccctttattcccttccttggaaggcagcctgcccttcagagtctgttcctgtgggggccatctcctgtccgcaggttctcttgttgcctctcctgtccacggtttctctggtaaccccccccgtccacggtttctctggtagccccctcctgtccacggtttctctggtagccccctcctgtccacggtttctctggtggcccgttctgtccacggtttctctggtaaccccccccgtccacggtttctctggtaaccccctcctgtccacggtttctctggtggcccgttctgtccacggtttctctggtaaccccccccgtccacggtttctctggtagccccctcctgtccacggtttctctggtggcccgttctgtccacggtttctctggtaaccccccccgtccacggtttctctggtacccccctcctgtccacggtttctctggtacccccccccgtccacggtttctctggtagcccccccgtccacggtttctctggtaacccccccccgtccacggtttctctggtaacccccccctgtccacggtttctctggtaaccccctcctgtccacggtttctctggtggcccgttctgtccacggtttctctgctggcccctcctgtccacagtttctctggtacctccctcctgtccacggtttctctgttggcctctgctgtccacagtttctccggtgcctccgtcctgtccacagtttctcttgtccctccctcctgtccgtggtggctcacaggtctctgaccaggtttcagcaccatggcaagctctgtcacaccctgaaaggtaaccaggaaacacagactctgacacagaaggtgcacaccccaacccctctcctctcttggtcttcccacccctagttcaccctgaggactgttatccttgagaagaataagacagagaacaaggggctctcctgtgtccccacacctcctcctattcaccaacatgaagggcccgctccctctcccagctacctctccattgttaaacctttcatgtaattcacctccagaactttcagtcaccttcactcattctggtctttagcctctaacagcacttcttcataccaagtccactctcttatattagtccttgttgctcttgcatccactggatttggggtatctgacccccaaggcgagctccccagcaagcacccagcgcagtctcactggctcctgtcagctcttcactccttcctcacctcacagaggctgcagtgggactctgaactgccccatcctcctacaccaccagtctccctggagcaagccatggcatcccgcccactctttcgtgaatgcttctgacatcttcctaaaccaggctgcaactccgagcctatacagccctctcagtcttcctacaaacccacagatggtacagtcattcttggccaaagttttcttctcttacatttgaccaaacgatttctgtgcattgtcaagtcaataatttgccagaaggtcttcttctaggcatacgagattttcagcaggtgcccggaaatatcaaaatcctgtcttattaggtgttttcagagagtatgtggaggtcatgcattacagaaaaatgaccttgaacttggagataacacaggcgaggccaaatcccagcccttcttgttaccagctatgtaacagggcttgagtttcttgactttcactaaggaaataaaaaccttaccttgacaggatgttgtacaattttaatcaaatgaagcagtctgtccaaactatacatcggaatgaccaagatagggagcctttttaaaagcacaggtttctgggcaccattccccagagactctggtttggtaggtctgaaagcagaattatcaaaaagccccaaggtgtttccaatgtgcccacagatttggggccacagaagtcacgtttgaaaatgcccagcacattgacctgatgggaggaggaaactgaaaattgagatataaatataactaggaagaatgcaccattgacccaataaaaaagttcttaggcgtaaaacacaaacagaaatgtatgcatggacatccaagatctgaaaagtggcaagtgtgactggggagagtctgggaaggccacggacaggagggtgaggatgggctttgtaacgggtcccccagcccattggagggagttagtggtagttgctacagacagggtgcaaacgcagcatcagagaggatttataagtcacactgggagactgttgaacaaggtgacatcactgagataggggctgagctaaaggaacctatagggcatggatgtggaggtgcccagtgaccaccaagaggggactgtccccaccctacccaggtccaccatatgccttggattggtgtaagggactgcagtcatggacactcatatgcctctccaggctgcctgccaactcccagacaagagcctccagtgaagatggctgtatcttcattggccccgtcagtttcagaaacttcaatgttgcctgggcagaggcatcaaccaccacaactgcctacttcctccaggggctacttagcaaatgtctctgcatcttgtggcacctggcattcctcctcatcctcctaaacatctctgcagaaggtctggctttctctctgtgggacaagcctcataggtgtgtgccgtttcattgatataaaatttcctctcctcatttgtcttccattgaatcccattcttccccttgtcaatttttttccaactctttgtatttcatgtttttccacctctaatcttcttgaccccaaatatgctttttccttctaactgcaatattcattgtcagattctattaggcttcattctctgagaagttacagtatccaaaagcagtctttaagccacatattttttcttcaattccagaaaatctcttgcatttatgtttaactctggacagagaagtcccctaaactgccatactcacccttagtgtgacaaagtgattggccccattcccaagactcagaggtccatgtatttgtggtttatttgttcctctattaaacattcatgtactatttgtctactatgagccaggcactgtgctagcactagggataaaagactgggtatggccagcatggcctctgccctcctggagcttaaagtctagcagggaacacagattcagattatccatggaagacttacttgtgtggtgagcaccaccaaggcagaccctgaggagggtgggaatatgtaggcaccatctctgtctactgtcttgggccctccttttttcatccccagccaataccagctgtcgaccacacacctacagtcaacaactgcccaaactcttttgatataagaaccacgtattgacattctcatccttgcttgaagcctgaaaaccaccagatacaaaatgtcacagattcagtgataacatttcacacaaagtaggtgctgctgttataattagctgtggttgaaaaataattcctacaaccaaggatttggcactaaatgatttcaaaaaatagaactgaaaaaatatgtttggtaatcaggatttattctggaacttgagattggtttgtatgggattatcttgtttttaccacactctatttggggaggaaaggatctgatatggcttgaagttttgctggttttcaaatgccagggattttgggggggcccaggggtactatccaaaccatagttcattgtactgtcctatacaatgagtgcttacagtggccatcgtccattccactaacctgagcttccaccactggaatttgccttctgagatctcccccagtcggctgatctgtgcttcctccatcacccctccctgaactcagctggcttgttgccccatgtccctcgcagcgtgaataatgtgtgtgggatgtcacatcccctctgatggccaactctgccagaaagctgggaacattgcattcagaaatcactttgagtgtaatttttctttctttccgtctttttttttttttttttttttttttggtttttaattcctacttgtgaactttcaaaggcagaggaaaaaaactcacgtctctatctcttcttttttgaaaaacaaaacccaaaagactcctgggattctgctcagagaaccaaagatgtttcccctcagctgaactcggccaccatcattgatatccacccttcctccacctacagcatccgcatgtacgccaagaaccggattggcaagagcgagcccagcaacgagctcaccatcacggcggacgaggcaggtacgtgggaccgggcggaaccttgctccagaggagcccgggagctaactcttgagggctcagatgcttaaatgcagaagcagacctttgcccgtgctaggcggaggtctttgatgcgtgctctccgtagttctgtgccctataaaaaacgcagacagcgctctgcatcttactttgaaggcactgctcttcaaataggatttagttcaagtttcccatacccaagacttaaaagaaagacgtatgaggctaacaatctggtgagattcaaagaatcatgccgttttacaattcctttgtttggacacatggaatccaggttgacaggagaaccgtgagtgtgtttctttcctgagaccctgtgaagtccagtgtgggaggaagcagtaatgcttaactaggaatctgcaagcatgcttactgtgcgggagatgtgggaaggggaacagattattttattgactagaaacatcaatatttaaaaataatgtttttgctcttttttctattacaaacaacattatatttagtgttgcaaattcagaagatagagataagcattgtggagaaggcaaaacagcttccatcattttcccactgagagctaacccaggaacaggcagtgataactggctaaataatttcatcacccacacacgcacatgcacacaggcacgcaccagtgtattcacaccccttaacacactgcgagccactcatgtttccgggggggtgaaattaacaggtgtgcagagaactgagcaatcaggcaatggtccatgaatgctgattgtcagcccgcctcctggcaggaggagaggaagccactgcgcttgggtttcatccacaaggattgcatgcctggcccatttattgtagggaaagggtgtccagctcccaaacctacctcttcttttcctgcccaccatcagagcaatcagccactccctactgcagggaagatggcagcttagtctcaagtccctgtttctccatcaccaagattaaggtgattgccacacccagatggctaacagaagaccggaggtttgttgcaactttcaagagaggttgatcttggcttccttcccaccacctcatctctgctaccctcattaacagcatcccaaatataaatggagcttatgtatctcttaagtacttttctacaatttgtaatgatatctctcactatgtgtttaacaaatctcatattgccaaacgggtcaattattttcgagttttcattagtataaacaccactacaatgaacatcctggtggtatgtcttttgctatctccaagatcattttcttagattaaatcctaagaagtcagatggctggatcaatcaaatgcaacattttcacccttctgatatctgtaatcagtgttgtcttcaagagaataggttaaaatgtacaactcttcctgaactgcagaggaatgcccatttttcaatgctggaagatgtcagttcttgaaaattgttttcaagagtgagtgacagaagatctttaggctgaagtgcctgagagtgagccatttctgagacttggattctctgtatgatttctcatctgcaaaatggacattatgatgcctttctgctccttacacagacatatctgatcactgaaaaaaactcaagctctgaaaatactttgcatgtctcagaaataagtgggaaataagtgttaatctgcttctgcaaaaaatagaattgtatttaattatgtatgtaaacaacccactaacttcctcagatccctgagatttcattatgctgggtacttagggagaataagctgtccccatccttcagcccaaaatgtcatctctgacttcctgctcaatcttctccttctctctcaagcccttttctaatctcgccccatcccagccacctcctcgggaaaacagcatttttccggtggtgcattttgcacctgcttttctgattgccattattaatgctgctgttgttgcttttttcttcgtttcctctgtgacctctgctgcggctggcagttgccatggaagcagctctctccctgccagaaggccaggtgaagagcctctggggtgctggtctgcagggcagctgcctggcatgtctgcagacagatgcagatgctgcctctttggctcccaggctggccttttgtattgtatctgggtgtgctggctgtggcagccccacacagcccctctcctttaatattcagaggagctaaggggaagggaaggaaaggagcaggttctagaaatgaaaagctacagcagataacttgtctttgtcttggttcataggtttgcatgactgaaattaaaaagtcaatttcccatgtgtgacttacctagaatggggtgctctggccaaaggcatcctcattagagtattgagcaggggctgtagacactgctgccccttcccagcaggtaaacccaaaggcacatctttttaggagctgtagctgtcttgaggtgaccttgtcccactgttcccttattcctcatatgggagcctccggaagctgtcagcccactcacttttactgtaatctagtacccaagtcttgggcacacgaggatgccccccaatgctactactttgcaatgacacttagtgactccccagagcccaatgcccagcactcacctgcctttgcatgctcccagacccctattgttgtgcttcttcccctgtcttgaaggcactacaagttccatgtctccttttctgtgcccttccttgaaaagtcaagttcaagaatgccttcctccctggtgcaatgcctttttccatctcccatgtgtagttagggactactcagctcaggacagaggagggattttgctgacagtagcctttgaggtgtatcatcatgtcttcatggaccctgctgtccatgatgatataccacctgatgtggaggggctgtggccccctccacatcagggggcatatgtgcttacaattctgtcccttgtgtgtgtctggcataagggagatgaaagtatgagatgaacgtttataaacattacccacagtattgcctttagaatgggtgtcacaatgagcagagtatgtgtgtgtgcgtgtgtgtgtgtgtgcgtgtgtgtgtgtgtgtgtgtgtgtgtgtatgtgtgtgttgagaaaatatatgctggattaaacccacagtgaaattctgaagggtgccctggtctgaatgttcatgccttccctttcaaatgaatatcctgaaacctaattcctaatgcaataatattaagaagtggggcctttaggaagtgagggtggacccatcattaatagcatcagtatgcccttatacaataggcccaaggcccaataagatcacttaccccttctgccccgggaggacatgggaagaaggcactatctatgaaccagaagaatgagccctgaccagacaccaaatctggcatcttgatcttggaattgtcagcctctagaaataaatttctgtaagaaataaacttctgagccaggcacggtagttcacgcctataatcccaacactttgggaggctgaggcagggggatcacttgaggtcaggagttcgagaccagcctggccgacatggctaaactccgtctctactaaaaatacaaaaaaaaattagccatgcattgtggcacatgcctgtaatcccagctacttgggaggctgagacaggagaatcgcttgaaccctggaggcggaggttgcagtgagccaaggtcgtgccactgcactccagcctgggcaacagagtgagactccttgtcaaaaaaagaaacagaaataaataaacttctgtggtgtataagtcatgcagtttagagtactttgttatagcagccccaaaagactaagacaaggacttcatgcagaaaagtagagaaaggtgaaagataggacaggaaggctgagaggaaagaagatggggaaagaatacagcccccatcagagctccagtgaccacccatgaaatggctgcatctggagcttgaggtgccctccccgcatcctgatggaatagggcatgtcccaggccataagctgcagcccacgacagaccaggcctgtggatgtgagtcggctcagtgttgtgcgaaacttttaaattcgatgttaatttttaaaatctggaaatttcagctgaaaatctaaattttgagttcctcttgagttcctgcttggcagcaatgagctggagttaagcatggagtggccatcccagaggctgaccataccccctcagtgagccatagttcccatcctccattcattgaaggatcagcaaactacagtcggtgagccaaacttcacctacagaccttgaactaagcatagttttttcatctttaaaaaaaaaaaaaaagaataacatgggcccataaagcccaaaatttgtactatctgagtctttacagaaatgtttatggatctctgatgaagtctggccaccatgggaatttgagttttagatttctgctgtatctactgcaaagcttagtgaggaagggattgctgccactggcatagtgtccctacctaatgttgggaaatctcattgctccaaccccaaactactcagtttatttgcatgtgttgcatgtgaaagtgcataaagcgttatcataccactttaatacactcgacctcagagaatagccatgaagccaagaccacaccattcagcgcagtcttcatggcttccccaaccacccctagcaccagcagcccccacaacaaaggagcagtcaagagaataagtgacacagtcggagttaatgagatgagctgttaatggacccgaagtgtgtctctttgacacggatcagccacgtgacacatgacattcacagctaacccttgctacagaccaacttccccattagcagctgccccctgcaggtcatgagtcacttagtgccttgtgaccgagtttgggatggctgcccccttcattattttcactataaatctgtgcatagaacatgcagcttcaattagtgggtgctcattgaaacaccactgaatttgacagaccatcagagaatagaaggtgtggattatggaagggtcatgatgcagagtcactgggtttccaatgaatctggcactgagttaagtccttgcctcatctttcctcccattccggggcagcagctgtgatctggaagaagagtttcctatgtgctgagctggggtggaggggagaggatggaatgagggcagaaggaataaaagtcaggagcatgtgaagcaaacacagggctagcagtgctcattagtgcagagggcggcatcaatgtgttcttcagtaagagtcaaatgcacagcattcactcagcgagaagagccgagcacaccccatgaccaaccaggccctcagcgatctgcctctgtagatttttgtcattctcctccatcctgggtttgaagaaactttgggaattaaatctaaagaaagttatcggccttcttgctgtccctcatacacattgtgtatacccctgtctgctatcctgaaaggttctggaacagttctggaatgttctgaaatgttcttcgtctcttcccttaccactttcaaatattattctccaagaatccaatcctggccaccctattaaaattcaacccactgcccactccactgggtcccctgcctcccttaccactctccttctagcagtcgcttgtatcagcacccagtgtactgtataagttgttgatttattttgcttatggtctgctttgatcccatcccaccagggcaggtggagttgcttgttctgctcactcactgctgtatcccaggcacctagattggtgtttagcacataggatgtgctaattaaataagtaggttaaataaatcagccatttatttaataagtagttattacatgacttcagcctttccccatctgggcaccagctattctttgtcgtattttgatttttactaaatactgtcttggttccctttgtccaacacagagcatgcctctcgcccacccacccaactcctgtagaagacaaacgtgtgtttgtagaattatgcagctgctcctcactactttttaaaaatttatatatttttttctgcttttgtatcccagtctttgcctagtttaggacctggcacatagaaggcaaatctcccaatcagaaccagaggcaaaaatgtgggactggttctcactggggtgattgagcccatatcaattaatgatgaggccccaagatgctggctaaagccaagatattgagacagggaggagagtattttggagcagaatggagcaccgaggcttgagtctcagctctgggagggacacaggagctgctgggcagtgggaggttgtccagctggggagggacagaagcagagacagcgtagccaggaaggatcaggacagggaagcaaagcggagatccatgcgtttggcaatcaggaggtgcctgtcatccctgtgttttcagccaaacagaatgaattgtcctgacttttacctttgcaaacataatacaaattataaagatagtcttcgcttattactgctttacagatcgaagagttttggatttcttagaaatgcagagtttattttgtaaaatcacttgttttttgtgagatggagtcttgctctgttgcccagactggagtgcaatggcacaatctcagctcactacaacctccgcctcctgggttcaagcggttatcctgcctcagcctccccagtagctgggattatgggcatgtaccactgcacccagcaaatttgtgtatttttagtagagaccatgtttcaccatgttggcaaggctggtcttgagctcctgacctcaggtcatctgcccactttggcttccaaagtggggaagccaattctgctttttctatatattacatttgaaaccatgtaagtaaattcttaaatttccaatgtcaacacaattttcaaatttagttaaataaatggatatacctaatttttgacccttaatacattttgcattggaaactcaatcggctttggactgtaattttataggcatcattggcaatgagatgataacctatgaaaaaattacagctcaggagttatacagaaagcaataaaattcttaaagaagggaaattttttataatttaaaaaatttttaaagtaatgttttagaaacatagtagaaaatttagtgccctttgtaaaacacaagcaaacaaaaaaccttcctaatgatattggacatagccctattgtgtgtttgtacaaattaaattattttggtttgtctggactgttttcatcactttttttttttttttaggaggagggatccaaatgctttcacttcagggaacaggcagaacaataaatacattactgacaaatcatggcagcattggtaggctaagtaataaagctgttacattcttaaaaacagttaagtctgtcctggatacaagaactgtaccccctctcctcttcagtggggaccttcataaaataccagacctgggcctggcatggtggctcacacctgtaatcccagcactttgggaggctgaggcgggcggatcacttgaggccaggagttcgagaccagcctgggcaacatggcgaaaccccatctctactaaaaatgcaaaagtcagccaggcgtggtggcacacacctgtaatcccaactacttgggagattgaagcaggagaatagcttgaacctgggcggtagaggttgcagtgagtcgagatagtgccactgcattctagcctgggcgacagagtgagaccctgtctcaagaaaaataaaataaataccagaccagattggaaaagtaagttactcccaattcatgattacattatgatatgtatgctatctgatagaattggggacattcttgtaaacactatgctggcacctttggtttaattatgaatatatctcaactggaaaatcaaggttgcaactcttgtgtgccatcttcctgagaggaccacaccaaaggccatgccccagggagcccagaggattcaggatgagacagtgctcctgacattgcctccaattcctaacaaactggcttcttgtcaaattcagttaagtgtaactaaattaaagtaacccagcctcagtatagctgtcagactcaaaaatcatttttcaaggatttttatggaaaaccgtgtgcttttcaatgagcacagaattatctgtgtgtgagggaaatccattccatgagtttttattgaatttgaggtccaaagtttcctgcctaagagcttgaccccatgtgcaagaaattgggtgcagaggctcaacaataatcatcaccattagctggaagccattctctccctcggctcctgttctggactttaacttcagttctagcagagcctttgcatttttggaactaatagatctgagaggctgtagcactccagactgccagctgtccctggacctgctgaggagagggatgcatgctcagcatttcagcatctacaaattgctttacccattcaaagcaaggactcactctgggcttagttcctggtgccatgtagagtctgctgggtgaccagagacatgcaaagacagacacgcaaacatatatgcacactacagggacaggtccccaggcctaggcaggtgtcagctgcagcgggaggctcacaggcatgggcggcaaaccctgatggagggagaagaaagccccagggaaaaggctcggctctacccaggggtcccgtgtgttttggacatggctgggacacagggtgcatagggagtgcgcggaacgaaagcgtggagaggacggcgaggtgccttctgggagcagaaaattactagggtgggtgaacagtgtgaattgtgctctggggccatgtcccttttaaaagagtacaatagagaccagaattaatgtttaggaactaaatagaaactgtcaccaggcatagaagtggggtgggagtggggtatcagagtgagagatagggatccccataaggacgatggtggagaaagcataggacaggggccatttggatcagatgtcagggacagcatcagcaagtgtgtgaaggaggggtgcagggaacaaacagcccagagacctaacccccacctcctctctctccagctcttgtcttttaacacctttgttttaattataagtacatcttaactggaaaatcgaggccgcaatgtccccatttcctttcaaactcatatttctaaaccataacaaaccacatatgctggagaatcggcttcgtttcttggcattcttatagtatcattctctcccagtcccgccagccctgacctgcggaatcagcttcctgcttggtcctcagtgcgaggacggagctgtggagtcccattatcctcttggagtagcaatccctgcatcttagagcactgactcctggggaggggcaccttgatagagcgccttagtgccctaagacacagggtgcacccttttctatagaccatagccattttccaagactttgttttgttccaaagcccataactctctccttcatgttcccattctgatttcctgcttggcttattgtcatattgttgagaaaagcaacaatcaggtttcaacccgcttctttcaaccagtaagtttacctgtgtctgccctcacctggcttccctcaaccagtaagcctacctaaggcctcccgtcgctctgccctcctcccatcccagaggtatttgttcctttgccccactcactccatagcctgtatcttctgccctcttcagtttctgccaggacattcattattccttcaagtttaccttttgttgttgttgttaaatttctcccatttgcttccccctatttacaaacacttaatgataattatattatgattatgatttcttatatttactgagcacattgttttcataacaaccctatgatacaaattccattggcccattatatatagagagaaatggagtcacagacaagctaagtaacccgcagaaaaagcacacagccaacaagtgatagaaccagaatgtgaacttggacagaaaaaactcaaatggcccatcaacttagcaactacatcatgctactactcagaacttcctcttcctttataaaaaaggaagggagctttcccttagtcatgcgcttccccaaatctaccctttatctataagatagctttacttttcccattacttccaaactccccaaaatgagttcatatccactacttcagctttcttatctcccgtgtgccatacaaccttttgcaaatgtccacagaactggctttctgtagttctgcagtgatctaaaaattgtcaatccaaaaacattttttaatctaaaggattctttccctctgatctctgtgtcgtcatttgcttctgcttctcagaagacacctgttttcctgctgccttgcattgcaaccttctttcagtgtgtgtatctcatagctctgattacattctgaactcttggttggcaaaatgttttacatctcttagttctacaccatgtacctagtaggtagcacatttccaacacatgcctatcagctctaactgggatgtaattggaattgtctctcattggctccctgtaattgagattgtctctcattggccccctgtaattgggattgtctctcattggcccactgacttattgcacactcagcagaaataggttgctttaaattgcacacttttgtttcctctttaacattgcttcagcactctgtggctagagcccctggttcacaagggtttttttgttgttttttgtttgtttatgttttgagatggagtctcactctgtcgcccaggctggagtgcagtggcgcaatctcggcttactgcaacgtctgcctcctggattcaagcaattctacctcagcctcccgagtagctgggactacaggtgcatgccaccacacccagctaattttttgtattttagtagagatggggtttcatcgtgttagccaggatggtctcaatctcctgatctcgtgattgcccgcgtcggcctcccagagtgctgggattacaggcgtgagccaccgtgcccggccacaagggtttttaattgaagaacaaaagccatgaaagacacccaaaggcagaagaatcttgattatttttgcccgaagtcattctaatcaattgagaaaccccaataccacatcactaagcaaagcttccagcggggagagaaggaccttcaatacacaccatagacagcatttcataagggaaattttgttttgcaactttctgttgtaccccttgttcaaaattgggattgattcacgaggttgtcaaagacatggtgagaaggaataccatgataggtccccaagattcatgtttccaaagagcaaataaacaaaggcctagagttggacacagtaattctacaaaattgacatttcccatgaccgctaaaaacttctttctctgtgccaaacatagggatgggttgtcctcggggaccacctttggctgtgtaggcttcgatctgctccggaaagcgtctctaacctgcctgtgggtttttggtccttacagctcctgatggtccacctcaggaagttcacctggagcctatatcatctcagagcatcagggtcacatggaaggtaaactcagcaaacatttgtattctcggtgctttccccccagggcgagcccttcactcctgttcagtgttatgacaccaagactctcgaattttacaaaacttttattttttcaaaattaagttgaaagcccttttcttaaaatgcagtatttgtatccacattttgaatacttttacagcaaattctgtgtctcagagaataaagtggttgtatcttttttttttttcttccttgaatcttgatcaaggtctaagcagtggtctctacagaaatagtaaaattgatgtccctgactgcatgctctcatttcatcccagcaaaaatgttttcaaattgctttttttaaatggcaaagcatgcggtggcagacagtccaccgaggtggcagaaaacaggccaagtcctcactgtgccactaactagatgtgttctcaagaaagcccctaaattttcttgccagtgaagtgagctgttgaatccactgactcccagggcagtgctaccccatgtgtggcccatagaggcagactggctgctggttactttagtgtttgttggaagtagctgggagagaaagaaagcttgagccacagtgtaaacaattgcatcactaagcacatcgtttcattcaacagccatggtttccatagcaaattttctcaagtaaggaagcagtgttgattctggagcaagctcatcaccaaccaccactgttccatggccttcaggtcagtagcatggccctgacctggtgggccatggcattagtcatcctcctgaatgtgctcttggagatggctctgtcttaggccaaattccgtttcatccagaacgttattatcgaatcaaaagttctgtaacattgcattaactatccccgctctgaatttctctcatggcatgtgattttttttcttgtctctttcctcaccgttttttttctgtggcgtcactgggagaagagggcagccaacaactacaataaggtcttcacatcacacacctcttctaaccattgcatctgtttgtttgtttgattgtttgtttgttttccttctagtatgggttctttcataagatgaccagcctctgtaacaaaaatggattttcattgttggggcggataccacctttggtattacgggcgttaatgcagcgagcccctttgtgtcagcgtttctcaaccgcagccaatgagttgtgtttccagcgggcagcgtgatatgactgtttagctgcatagaaagtgcaggccgaggagtgtgggaggtggtgtcattggtctttgtaagcacatccaccccctgcgagcatcacacacattgtagaataaagacgctcagcaagccataaccccacacgcattcccgccactctacaaatggaatgctgactcactctgtcttgaattgaagactgtgaagttttacccactagctttacacattctctcgtgttttgccctgaaaaagaccaggtattactgtggcctcaaaagctttttggatcttttgggtcctgcatgagagaggtgtctgtccacagaggatctagctcttataactaaaaatggaaacttctgaggctttaaaaggcattgtatcctttctctctctgtagaaagcagccacaaaagtcagtgcattgcagttaaatttctctttagtgccaaagggtgaaatgttgtgggactattaaaaggaagcctggctctcattagattgtgaatcgactgaatacattgttcatggaggagtgcaatctatctctgtagtgggcctttgtggcatggcctgtcagcaggcagacttgccggtgatctaactgactaatgaggttggggctgccctgtcaccagcttagcatttcacatcggcctgtttatataatgagcttttaaaggacaccactgattcaatcgaattggacactattacacgaaatcttaagtatatgtaaaggacaatatgttacatataacatgcctttatttatggcataaaattcagaatatctgttttgtgtaaggagaaagaaagaaggagaaatagcgttagccccaaagagggagccccacatctgtcagccacggtggacatatgcagtcgtgggaagtctaaggtggaagctcattcatggtcacggacactgatcagaagtaaaagatgcattcagtacagagacacagggtaaaggaggaaatagctctggggttttggtgggaaaatagccatttagactctaagcctttgaaaggtaaggggcactttggtggcctttctgtaacactggagatagatattacatttatttaattatcattgaataagcactgcttctgtaatgacaccctctattgatcaaaataagcaactttccacttttatttcattttattttatttatttattttgagacagagtctcactctgtcgcccaggctggagtgcaatgacacgatctttgctcagtgcaacctgtgtctcccgagttcaagcaattctcctgcctcagcctcccaagtagctgggattacaggcatgtgccaccacacccagctactttttttgtatttttaatagagacaggggttttcaccatgttggccaggctggtcttgaactcctgacttcacgtgatccacccaccttggcctcccaaactgctgggattacaggcgtgagctaccacacctggcaccctttttatcttagttatttctttcaccaaagaagagcttctaattttaaaatctttcatgtccagcaaaggttgctcaggacctagtgaatgcagccatcctacatcagctgcagcacctggattcaggccccttatcttgcctcgccttcccagggatacctacccaagcagcagtccacaagtgtcatcgtctctcctgtcagtgttcaggcagtttgtaacatgcttacctctcctgtccattcctgctcatttgaggctcagattgtgcatgactgcccccatgaagatgggaatccccagagtgcaattagagtttcaccctctatgttacccattgctcttggcgatggctcagggaggttcccacccagtggcttctgcagtctgtttcatgtgcatcccctccactgttctgggagctccttggcagcaggaagagaggcttactcagttctgatccctcatggctggcatgtgttccatgaatgaatgaatgggtaagtgaaggagaggtgagtgtatatgtgagctgggaatgaagaggcctagaagacaagtgttccatatcacaattgcctgtgaagcattacgtgtttccaagactgccatggagatggcatccccgctatcaggatctccagagagcaaacatgctgagctcaggtctaactcatgatacagtgaaatgccctagactatacaacggcaggcacccaaagatgtgaaccacactcagtacaccaggcgaccaaccacttttcatatgagtttctactatggtaattttcaatatagtttattgaaaagtaaagggcagtagtggtccaatttgtgataagtttcatgggaaatggacatcttcacatcccaaatataagcccatagaaagatattcaagaggaatatctttctataggctatattatgatgtctatattatgcaagatgaagtctcagaaagggctcttaaatacttttacaaatattaagctaattaaagtgctaccccatgccttgacagaaatccaaaagacaatgtaagcagttctgaataaaattaaaagtaaatgacaataaagtttcatttgacattcttggagaaacaaaaggatttgtgtaagcaaatacaatttaattcatggcaggttttgtttctgattcaaaatcagaaagaatatttaaagctatggataattgataacatatttgatgaagtacctgaacattgtacaactaaggaattctttggtttttcagaaaattccaatttttagtttatctcctaaagtgtctcttttagcagtgcctgtcaccttctctcctaatcagtctcagaatcagctgaccctctttggatgcaaattaaggacaatgtgattaccagctacttgtgtgcatgcttgtgtgtgtgtgtgtgtgtgtgtgtgtgtgtgtgtgtttgccatggtcactcataaaataaaacattcattatttagaatatttaatgattatatacatctcaaaacatttatccagagaatgcaatttaagacagagtttttttcctattgatataaaatttgtgttgttgttttatttttgcattaaataagaaatctttgcagaaccacaggctgtccccaaaatatgaaatggtcaattgcttaaatatttctgtgctgagaacaattatcaaagtgattacttgcaataaaaatcctgagaataattttaccatttggccctcagtattgtactatctgcgtgaaaattttactgagaataagcaaaattctcatttagaattaagaaagagaggtatgatttctgtaaaatactaagttgaatattcagagatttaattaaatttcagtaatctgaagaatatttttaaccagaatatcacatctccactatacccaataattccagctaattgaggcatcattacaacctattaagtttcagagttgagctcttacaacaggaaaatgactcagtctgtcatttaaaaacaaaactgccttatttccagtgacctccgtagtcatcgtttaataaactgcaggctccacttgccttctgcactaaaatccctctaccccagggaagtgcaaggtaccttggaaaaggcagtcttggaggcaccttccagcactagtatttcctggccaactgggacagctgtccttagagatatttgctccccgccaggcacaatgctaaacttctgcatgcattatctcatttgatctgtgagctgggaacacccagttttgtgcagagggagatcctgaagtcaaaggaacttacccaagttctgaaggctggtgactgtcagattgaggacttccacccaggctgcctggttctgcctcctgggtttctgagcagtcaaccagttaattactaggaagtgccaagattgtagttcgtgcataataatgctcaataaatattaactccctttactattccttgcaaactcatgttataaattatacccaaccccataaaaattaaagatatatgaaatttacattcttacgtagtatccttttctttccaaattgtaaacttaagcttagagtaactttcatagtgagtagacacccttttttcctatatcaactgaaattcaaaaaggttgccttgaaataaactttacttaattcttcaactatcactttaatctttaggctatgaaaaatgacaaaagtttgcatttgcttttaggaactaatccattggttctagcattggttttataatagccttattgaaattcctgaacaccaacatgtcttacaaatacttaaagaatttttagcccttctcatattaacgagtctaacctccttccttgataacaagaaaagaaaaaaaaatttcaaaatctctggtcatccgtataaagtaagattgttctttctcaacttttttaggtggactagactctaggttccgtgagggttgaggacatgtcttgtgtgttcactgtaccctcagcaggagtgcaattaatatgcgttaaattaatgcataaaccatttaccattgtttacttttatcataaaaggttcatatcaagaggtggtgcttttaaaaaaaaaactgtggactttctagaaagccctaggtgactaaatttgcatctttttggtgtatatgtaaactatgcatgtttctttaatgaagccatggtgtttatttataccatttggaatgtattctgcatctctccgtctatacattgggttactcctctcggtttagccatgtgatgggccttcttcaaggactccagttctctgtcccaggacagagctgccagcctgcatgcacaaagggtccggcaggtctcctcaactaagcaggcagttcccttggtttccagcctagagcgcagccaggaaaatgctggctgcatttgcaagagctactcgcagccacaggggtggaatctaggtctgatgctcaggcaggctgggaagagacactatctgggactgtcagcctaagaggcaattcttgattcaaaccccactgaaaaagctgtacctctccagcagagtggccttgacaggacacaaattgaacttggactaaggcttaggaccaaggccgtctgccgtcgagccagaaatcctgttggatggtttcttctaagagtttcacgttgagtctggatgaacacaaaaaatctaagtgtaggcactttgattttttgtataacggttaggttataagctgtaaagttgcaatataactttagaaggcaagtattgtatttgcctgatttaaagagcatattatcagaaatgcaaataaggttgcaactaaaggggtattttggacatctattgacgctcatccttaggtgttttcttagtgcatcaacattacatttttacaattggaccaggtcctgaagttgtgacactaggtcaaaaattgtgtatggtcagaatgatattgaaaatgacttaaattgtctaataagcacactatgcataatattcactaggaagctttacagtaacatatatatacaaacatgtaatattcatagtgaaaactgaaaagtacatgtaaaaatataagttgacactatttcatcacattttaaagtaacattagcgtaagttaaatccatttccaacaagtaaattatatataattagaatacagtgtaaaaagtactggattaaatttcagaaaattagatacgacacccatctctacacctaacaaaatgaccttaagtcacttgatttgtcattattggaacttgaacccttttctctagttctgagttgtgtgttttattcattatgtcataaccaagaaagtagcagtgcattttaatgatgaattctcctctctcctcacctcccagtgctgacttgatagccatagaggataacggatgtgggcccactctggaatccataaggtggtcccttgattaacaaccccgatttggatccctatcctagatgctgattccgcccaccccaccaatggctctggacagcactgccatttctgatggcaaatatctcccaataaatgtaaatgtggtgaaattttcccaacaaaaaatagaagtttattttcagtaacctaataatagatggatagggtcgggcacagtggcacatgcctgtaatcccagcattttgggaagccaaggcgggcagatcacttaacatcacgagttcgagaccagcctggccaacatggtgaaaccctatctctattaaaaatacaaaaattagccaggcatgatggatcatgcctatagtcgcagctactcatgaggttgaggcagaataattccttgaacgctaggagacagaggctgcagtgagccaagattgctcaactgtactctagcctgagtggcagagcaagactcgtctcaaaaatttaattaattaatttttaaaaatagatgggtaggtagtaatttaataaaagtattcagaagaccatcttagacagttttatcagttctcatataatcctaactctgcttttcacagagaacaaattggaaaatcaagctaaagttaatatggcattgagcattatgaatgcatggatgccatccgtacagggagtgcataggtggatatacactgtttaatgtgctgtatttcctcagacagcagtccttaagccatctcgctgatgacatttcccatcttttcagagaaatcaagtgagatacataagttagtaaacagggcacagatgttagaatgaaaaaggaaaacatatatccaatcaagaattacatagacatcatcaaatggcatctgctatgtcatggacccctctcctaaggcaagggaagaaacatgacattagttttattgttattattatggcaactcggctggacgaagttggttagggtccatcacaggaagaaccccagccaggagggcacagctattttccagactattttcaaggtagcatgaagcaagacagaaaaacacaatgtgtgccttcaaacgtatttcactagttcaaatacatttaagttaatgcactaagatgtaacaaactatttcaagatagcccataacatttttaaagccaaactcttcattgtattaaaaatgctgaaagctacttcaaattctttcaattcctgtaataaactcttcctgttcttttgaaaaatttaagttgagaccaaaaataaaagtactttgtgctttgagtaattatagatgtataagaaataaaaccattttaccttcttgttttgcctgccagtaacaatttgaagttggaaacagggtttgtttttctgtaaataacagaagaatttaggtggcagatccttagtgaatttaggaaacaagacttcccactgaaggagagtgtgattcagggagtgcctgtgttgctcccgtgggcccgtgtggaatctgtggcacgtgttgcatctggacttgtggagtatttcccctcaacataagccagagtgttcacaggggcccttggtctgaatgcttctagcacattcctaacagggaacatacagtagcctattggacaactgtttcttttctttttttcttttcttttgtttttttgtttttgtttttgttttgagacagggtctcactctaccacccaggctgaatgcagtgtagtggcaccatcctggctcactgcagccttgaccttccaggctcatgtgatcctcctacctcagcctcctgagtagctgggactacaagtgcataccaccatcaccatgcccagttaactttttgatttttgtagagacaaggtctcactatgttgcccaggctggtctcaaattcctgacctgcagcggtcctcctgcctcggcctcctaatgtgctgtgattacaggcatgagccactgtgccttgcccagacaactttttcaatattctcctcgcaaatacctattcatgcatgttgatgtctaaaattctctttagtcaaggctaaagcttttcattacccaaaaatagataagaggctaggcatggtggctcacacctataatcctagcactttcaaaggctgaattgggaggattgcttgagcccacgggtttaagaccagcctgggcaacatagtgagacctcatctctatcaaaagaaaaaaaatagctgggtgtggtggtgtgtgcctgtggtcccagctgctcaggaggctgaagtgggagaatcacttgagcctgggaggtcgaggctgcagtcagctgagatggcatcaatgcactccagcctgggtgacaaggcgagactgtctcaggaaaaaaaaaaaaaagaaaaaagaaaaggaaagagagacaaagcctagctctagagaaagaatgccatcctcctcttaatccctactgagctatagagggcagatattgaatccaggactggagctccattgttactgcagacattactattccttgtcttctgatagaacacaagttagaactatccattggagcatggataaaaggagagtaacgaactctaaccaacactgggcagagcccaggcctttctccaatgctcctttcttagtagtgcctctcctgtcaacctttctcccctctctccttcccaccctgccttggacctgcagcacacccagtaagttctacctcacatgctggttctgtccacagcactgtcctgtacgagtctgcaaactgtttctctaatgggccagagagcagatattttcagctttgtaggccctgcagtctcggtcttaactgctcaattctgctgcataggcacagctgcagtccatgcgtggatgagtgaagacagctgggatccagtaaaacttcacctaggaaaggtgaaatttgaagttcacataattttcacatgacaaaatattcttcctcttttgatttttttcaatcatttaaaaatgtaagccacaacaagaaaccgttgttagctaagagccacataaaaacaagcagccaaacagatctggaggagggaccagtttgtcaacccttatttcctggattgagatgatctctcgagagggagccacatccaactgagagagtctcatctgagacaaggctagcccctcccgccatatatgatatatgctaaatcatcactctccagttcaaagatccacagatctttggggcaggggcacaatccctccaacctctttgctaatgcataacagaagtgacctttgctccagttcccaataagttcctcatctcgtcttagaactcctcagcctggacttctttgcctatatcactaccaccattgtgatcataacaatttaacaagtctctgggaagttccagactttccctcatcttcctgtcttcttctgagccctcaacactcttccaacctcagctcattacccagttccaaagttgcttccatattttcaggtagctttatagcagtgccccactcaaaaatggcttctggttcattggttcttttggcacagatgtaaagcactcaggaattccttccagttataaaattaaagctcacctttcagtgggcaggctccttctgagacctggatcttctctggttcttctgaacagatacttagcaaaaatgacaaaggctgcaacaacccggcgtgtgactgatgccgcttactcctttacaagcccctttctctctctctctctctctctctctctctctctctctctctctctctctctctgtcttagtttgactgtcacagcttccacctgcctcctggcagtgccgttcccatctgtgtgtcccttccagcccagggtcactctcacccgctactggctctcagcctcatccctgtggattccaggactcagtttgtctccatacttaccctctcctcctacatcacttaagggttctcttagttattctttaatttatattattaaatataatataaattatattatatatagggtgggagggaaatggaggcagttccagtttaaggacctacagggtagacagaggctgccctgtgtgcatgtcagagcactggctggggcgactcctggcttggctccctgccttggcctccagcttcccacgccctgccctccccagtggaaagggcctgtttcgttccaaggaagattcttcttcaccctcctttcctgccttttctcatcaagacatccaggatgcctccagagcatgcagacccagtggtttgttggggtgagaggtggatgtggatgtgccttcatctcactcagctccacccctgcccgactgacctctttaccagcggtgttggatcatgattggccctcccctggcgctgtcttacagagcttccagaatcagacactgtcttctcccatcccgcaaaactacttccgagcatttttcatggccccatgaccatgcctttgaaatcctgcctcttgtgcttgtttatcagattggagtcggggtgcccctccctcccttatctctgtggcctttctcgggcccctgccctgccctccttggccacactgccgttacagggcctccattacctgcagaggggctactctgggttgggccctccaggcgtgtgtggtgggccaaagccctttgggttcactcagccaccgctaaatagttggggcccagcctcaggctcacagactagcataccccctcttttgcatcagagtgcaccctctaggtccccattgttgggcgcgggagctaggtgggggtattcccagaggccagccctcagagttgattcataggaagcaaagcccgaatgcccttgtgtggtccttggcagagagcactgataggcctctgtggctggtaggaaatgttaactgtggttagcaggtggtgtgatgtatgaggaacaacagaattcaaaaagggagtgtcccaaaaagaggagctatgtcacaggtgtttgttggctggatgaataaagcggaagctgtcctacactttagaaatggaataaatggagttttgctttgcagtagttaacctcaattccatgtcataaaattatcaatctatttctagcattctgcatttgtgtctcaaggcaaagcccacatataccttggccactctttcctcctcagctgccaagtctgactagaatatggcagctgcagcctgcaagtaacattcttggctctcaagacagtgcctatttcaaataatctgtcatttatcatttatttctcaaactgaaattgcacagcccctttgttctaagcactgtctcattatcaggtcatgtggcccttttctatttcatgaaatgtggacatctcatcctttcctagctcctcaaaagataatgactttgggggagccagtcacgtggccatacatctacccattatgagacctaggacacagatactgtatttaatacagtgcaactctaaggagagatatatgaacaaaaatatcatttgagaccggaagcagtggttcactgctggtaatcccagcactttgggaggctgagttgggcagattatttaagctcaggagttggagaccagcctgggcaacatggcaaaaacccatctctacaaaaaaagttcaaaaatttgccgggtatggtgacatgtctgtgatcccaggtactcaggaggctgaagtggaaggattatttgagcctggggtggttgaggctgcagtgagccatgatcccaccactgcactccagcatgggtgacagagtgagaccctgtgaaaaagaaagaaaaataaaagaaaaagagggaaggaaggaaaggaagggaggaaggaaggaaaggaagggaggaaggaaggaaggaaggaagaagaaaggagaggaaagaaaggagagaggagaggaaaggaattatttgaggcaataatgtaagaggtctcctcgacctgacatagccccctcaaaatccattgtccatggaccaagatagccagctggttctcacaccacccctatacctattgtaaagcagaatccctttagtgctgagtaaggtagatctttaaattactcccaagaccaggaaggtctaacagttttatgtgcatttattcccttttgtttggccaagaaccaggaaaatgggctactggctaacctgagaaatgggggaatgcatagttgctgctttttaactaaatagtctctcccagcaaagccaaatctaaatcactgagtgactcccagtgataacaacagtgattctcagactcagggagcactggtatcccctggagggctttttaaaacacacctcaccaggctccacccccagagtttattcctgattcaggaactctgagtgggtccccagttcttgcagctctaacagttttccaggtgatgtggatgttgctggtagcgcaccataccactacatacaggctccataggttctgtcccgtagatatgtccctagcttcatctgtgcttgtaccgtcccccacccctgtgatcaccatggatacctcaccccagagtcacttgagcctctctccattcctgggtgtcttctgtccttgcacctgggtgcagctgtgtatgccaattgctttggcgacagcattgtaccctccaaggcaatgtccagtcaccctttagctcaggtgaagtatgctcttctctggcaatccttctgaccacgatttgcccctccatagtactctgggcaaaccttcagcactgcaagtatcaggcagtattctgagcactgattcactcaaaggtgtccctggttgtgccatgccttgtgtagaacagatgcccagttaaggtttgttcaatgtgatgcacccattcactgagcaagcttatggaatggctactgtttatgttggaaagcaggtaaggggaggctgcagaaaacgcacaaagatgaaaaagactgtccacccaacttgtcacataagggaaatgaggatagattacattttaagtggatttggaggaatctataaagaaaatgttcaattcatttcccaactaaattattcagcatgcctgagaaaggcagcattcttcaaacgtgaaattctgcagtgaggctcttagcagactccagccaacaggtgaattctgcacatccagcagaggccatttcctttcaatgggaagggggcaggaggcatgagggaaacagaacatggctggtggtcttcagcacaagagatgcctgttctaatcattcacatccaggcaggtgcagtgagcatttgcacgtctactgttttactgtccctttaaaggatgatgcatctgccacaggcggcttgcagccgactgattgagaaggacatataaaataagtcacttgcacaccgtgcaaatacattgacatggtgcgactgttgtcatggagatcaaaagagaaggtttcttaaaggaagtggaggttgggagggatttggaagctggagaaagggcatctgggaggatgaaaggaggctgttgaggaggactacaggagaaaaaaacctgccaggctaggaagggggagagagcattccacagatggcagataaatgaaagaaatgagaagaaatcaggatcattactgaatccaaaggcaaatgaatgggggagtaaagttcaacatgggaaaaacaatctttgtgtgagaaacctaacaaggagcaggcatgaccttctcttagatttgcactgcgttcaaggggatttgagaagaggcaaacagaaagcactcacttaggaaagaagtcggttgtttgtaaatacgtcctcaaggatttctttaacttaaacacatttctaaatttcaacattttccctgtggaaagggccttgttttattgagttcttaaataggagtagaagggagcccttagttttttgttttttttgtgtttttttttttccatatgcttacgtttcaaaggactcctttaatttgtcttaagatgactggttaccaggtgagatttgctgtaaatctgcaggtccatcatcataaaaacatgtaacccaccggctggctgagtaagtgagcaaattctctttctggaatccttcttttaagaaggaaaaaaatgaatgacagtgtccaaataaattggctcatcagaagctattttcatccctggtggggcctgggcaatgaagctcaacccctccaaatcctgcctcaacctgtcatccttctgtgtaggccagcaggctaagtcccagtgcggaagccaactctcagcttgaatccacacttcccggctgtcacactagactgctgagttctccacttctgtagtggctaagccaggcctctcttcaacagctaaaccatgtgtctgcagtcaaggaatttcttctgacttcatacccttgctatcagtcctttacccagttagattataaacctgtacctgtgatcattcttacccacctcttttttttgcatctcatgtgtgttcaaaaccattctcttctccatctgcaagaatatcttctgagaacatccacagtgttgaagccccgatttagacagggggaaataacaagtgagatttcattctgtagggttctttgcattctagagcttgcaatgacattctttgaaaccacgtttcattgagaatggtggccactagaggaggtagaagtgatcagtgaatgccagtggagaccagggagggagaaggcttcttggtgggagtggtctagggaagagccctggtgagctggaagctgagctggcctgcagagaaggagtagtgggggtattctttgaaagaagaaggaagaacattttttgacaacagcttttataaggtgggaatatgtaagacagttgggatccccaccctttttcaggcagtcagagaggaacgcaggtgagcaagcaacacccaggaggcattagtcttgagagatgaggcagcgatcagatctcacaacaggtactactgagatcgggagacagagatcaaagaggcatggtcaaagtggtttcctaggaaatttgtcttctccaatattatgcaactcagattcaaaatatgtttccagatccctacctgatttcttgttttccttttcttcttaccccaccattaacctcattcactgagtttcatgaaagtgaaccattatttccacccatgtatcaattgttctacagtgctaattaacaaccttaatacagtgttctaaagatcatttccctataaggatatattctctataccccagaaaaccatctccctttgttcctagtagacacatgctccaagcaaagatgtctaaagcatcattcaaaacaattttccagttaaggatcttatgcactaatttgccttgggaatatgaagcccactgccagacaaatggattcacgtgtctccactaagcacaccttccactcctactgactcatccataactcagagtgagcctctagtgtcattttcgaaaacctgaaccacaggccataacatttcttacacttaatatacaaaatccctacatttatggatttttttcagaggttgttttaaaatacatccacaaggatttctttaatttaaatgcatttctaaatttcaatctgactagtctatctacaaattaataaagtaacttaaactttccctgataaagaatttttgcttgcttttatgcataaaaatatacaattttctcttcatgtgatctattaaattttcctctgattagaaatgccatgtatactattactttacaaaactaacaaactttgcaaaagggtgaaaagttctctgaggctctatgagcggttaataccaaatacaactttggagaattcctaccctgtacttgccttgagatagttgttttaacatatttgaccttttgtttcttcatgtgtaaagaagcatacttatactgtgtggggttttttagggaaagaaaatgaaataatatacataaagcaccaattacaatgggaaaaaacagtgttcaataagtggaagtggaggtggtagaggtagtagtagttgtggtcattgtggtggcattcatgttggtgtgggatagtaatggaatgatggatggttgtggtgatagtgatattggtgttgggatagtgatggaataatggatggttgtcgttatagtgatgttggcactgggattgtgatggagtgatggatgttgtggtgacagtggtgttggtgttgggattgtgatggagtgatggatggtggtggtgacagtggtgttggtgttgggatagtgatggagcgatggatgttgtgacagtggtgttggtgttgggatagtgaagaagtaatggatggtggtggtgatagtgatggtggtgttgggatagtgatggagcgatggatggtggtggtgatagtgacggtggtgttgggatagtgatggagcgatggatggtggtggtgacagtggtgttggtgttgggatagtgatggagtgatggatgttgtggtgacagtggtgttggtgttgggatagtgatggagtgatggatgttgtggtgacagtgctgttggtgttgggatagtgatggagtattggatgttgtggtgacagtggtattggtgttgggatagtgatggagtgatggatgttgtggtgacagtggtgttggtgttgggatagtgaagaagtaatggatggtggtggtgatagtgatggtggtattgggatagtgatgaagtgacggatggtggtggtgatagtgatattggtgttgggatagtgatggagtgatggatggttgtggtgatagtgatattggtgttgggatagtgatggaatgatggatggttgtggtgatggcaatgttggtgttggaatagtgatggagtgatggatatttgcggtggtagtgatgttaatattggaatagtaatggagtgatggatggttgtggtgatagttgtgttggtgttgggatagtgattgagtgatggatggtggtggtgatagtgttgttggttttgggatagtgataaagtgaagcatctttttagtgacagtgatggtggtaacatcaaggatgatgatggaagtagtggaggttaaagtgtggtttgttggtgaagtttgtgataaatatggtggtaaagttggaagaagtgatagaggtgcttctaccattaggttaattttatggcagtgatgttgatactggtggttgtaatgttggtgatgtcagtggtagagatgctattgctggtggtggtggtgttcacagtatttttgacagagatgaagctggtggtgatgatggtggtaaagatggtagtagtgatggtggtggcttggctgtgtgggggacctgagggagtggcattgatgttggcagtggtgacagtgacctgcagaggtggtaagcattgattggtggtggtggtcatcatggtggaggtgccagttagtgttgtaattgaaatagaaagataacctagagatgagttagcacactacctttgtaaaaaacagctttattgagatacagttagcatgccatagcattccctattttaagtgtatgattcagtggtatttcatatgtttacagagatgtgcagccgtagccataattgtaaacatttgcatcaccccacagagaaagcttgcaaccactggctgctgctcccatcctctcccactaccttttaagtctgtttttaaaccttatagtttggggacctgcaagctatgaaactgaaagtatatgttccctttataagaaacacatctcacttcttcctcaggtgcaacaatttattctgcatgaaaactatagatcatattagcaccctgaaaaaaaaagatgtaaaaacactactaccatcaaataacgcataactctactccatatatttcatttcaaaattggaatattaagaaaaatagaggagagctctcttgtttgttccttgtgatataatcccttaacttaccctatgatattgcacatctggaagaataataatcaaaaaagccctatctcattaacagccaattgaaacatggacttaaaaaataagatggtcatctacttctgggacttgagttcaataaataaacttagaaacagagaaactatattgtgaaggtgtctaacatagcatttgtggtagtaaataaacctggaaacaataatatccccaacaattaaaaaaaggttaaataaaataaaacatcaatatgatggaatatgatatttaaagactatgaagtaaagatgggaatataatcataatagcatattaaatgaagaagaaaaactcagacactaaattgtacaggctacaaacacagctatgtggggcaaaacactttactttagataaatagactgaaatgcatcaaaatgtgaatagaattgcattggatagaaatggtggttgtttacttttattataaaacaaaatgagataattattccacacaatattttgcagaagtatcaactaagaaaaaataagctttattttagaaccacaggactgaaatgtagttcttctaagaaaaatgtaaagaattttctttttctttttaacaaaatattgaaatggaacagaacaaaaacacctgcgttgtctattatagttaagctagttaggatgggttttcacccatggagaggaaacaagggaagatttctcctttctacctgtacaaacagatcacaggcaggattaatccccccaaactggaggaactacatgtcagcaagcaggtcccttcattcttgtggaggatttagctaaattggtggctctatgaaaacactttctcacaggcatttgactttactgtctactcttcttgacctgactccacagcccccatactgtgaatccaacttgctgtcttagggaggcttaaagcctcaccgggagccagttgaacaattagaatatttaatggatgtaaatctcatttaaaaaataatattattttatttgggtcactatatctaacattaaaacactaggtaaaataggggaaatctctttgttggtaaatttgacttataggtgacgtttacagggaaattcatttgattaattaattaggtcacataaatgtaattcagtggttgcagcaaaacaattttcacatagagtaattgaattttcaaaacatagaatcttgaaatctatttctaaacagtgagaaaagccatagctcatcaatgcaaaagccagcacatctgtggattcagaggagcatagacatttgtttataataaaaaaggtatgagctcttccaccagggtctaactccgagccaacagatacaaataaataaatggtttacgcgactgtttcactgacacctgctggcaccatgaatatactaaattagattggctgttgggaaaagcaagtggagtccaagaaaaccataaatggagaaacttgctgtgaaaaacaaaaatgattttactgctcttggataagtcagacttactactaatgacaggctgaggcatggaatcccctgggaagttattattaggcaatccataagtgtttgctgaatccatcaatgctgttcatcagctcgaaaccttcttctgacttctcattgtctgccctcccccggtcacatttggcaggttttcaaggtcttgctccactctgtccgttccctcctgacttaccgctgggcaggtgtgcaccctttgcaggctccactcaccccatcctccttctacttctctgagccgtgccccgccacctccccccctccgtcaagcccacctgggctctgagtcttcccaccacttcagaccacccatactcacactttctagatgcctgctggccttcactttcttaccatgcatttccacacttcatagttctctacaggttcttaagtgcttatttcctctctgcaggtcgattataaacactttcaggacggagaaagctttcagaggcttgagagatccagatccatagtttgtacttaaatgtatgtgtgtacgtgtatatgtatatacatacatatgtacatgtatacatacatacacatgtatgtgtgtatgtatacatacacgcatacacataaacacacatatctgttgactgcctgaaagtctacaaaacctttattccctagagcctcatcttggtggcattcgcatatctttttttactttttgagactgagtcttgttctgtcacccaggctggagtgcagtggggcaatctcagctcactgcaacctccgcctcccgggttcaagtgattctcccattttagcctcccaggtagctgggactacagacacccaccaccatgcctggctaatttttgtatttttagcagagacggggtttcaccatgttggccaggctgttcttgaactcctgacctcaagtgatccgcccacctcagcctcccaaagtggtgggattacaggtgtgagccaccgcgcccagccttataccatccttgaaaaggctctggtttctaaatgagtcctacgcatcagcctaaatcctactttgacctggtggaccatcttcacatcagcagggtggagttagcaccagcctctctcttgccccacatttaatcacccccaaatcattccagaatgattcggggcttcatgaaagagattaccttcctattgggtgtgcactcaccttcccatgccagttttcaacctggaaacactgtgattctgggatatttccttagaatgtaagctccatgaggacgggggtcttttcttttgtcttcttacatttccaaactcaattctattccctggtgcctggaacaaggcctggcacacagcagcgagcccgagagttcttgctgggtgcaggcctgagggtcagtctcacccggtcgtaagcgtacctggagacgccacaaacatgatctgtattttgacactttctcgccagttagacaagtcaaccagtacatcatgaaggacagaatgagagcgcaggctctggggcccaacacccatgttcagattccgctcctgccatgcatactcaggtgacctcctgtgtccattgacggtccagtggctcagaggggctgggagggccggatgcattcacaggtaaaggaagggtgcctggcacagaccaagttgcactgtacgtgggtttgcggctgctaccggaccaccgccccagcatcgtggcgatgactccactttatttctgctttcctacgtgggtgtgggcgttgatttcgctcttgtcctacctcaagacttctttagtgtgttcttttctctcctgtttaggctcccaagaaacatttgcaaaatgggattatccgtggctaccaaataggttaccgagagtacagcactgggggtaacttccaattcaacattatcagtgtcgacaccagcggggacagtgaggtttacaccctggacaacctgaataagttcactcagtacggcctggtggtgcaggcctgtaaccgggccggcacggggccttcttctcaggaaatcatcaccaccactctcgaggatggtaggttcggccggggcctggtcgtggcttttccctccgcaaaggttccctcgggtctgccccggggctcccccaacctcgcactcccccgccccacgactttgcagtgacctgcagggcctggggtctcgggtggaaaagccttccctcgtgacctcgcccaccccgctgatctgcccgccctggggcagggctggactgcaaagccagcaagtccctcccttttcagactcttcctcattcatttcaggtacaagaattgggcttttctggagtgaaaacaaggctctctctattactgcagaagtctcacgagaatgcagaaatgctatttgctaaaaaactttctcccaaatgttaagaaggttttttaaaatttattttatttttcattgtttcctattttcaagcattctgagtacagagaaaaggaattttcagattgcacagtgatcgatcgccccctagcggccgagataaattaattagcccttccaccatgtcactgagaataacccagaagctcaaatttccagtagtgcttgaaaatagagaaccctggtatccagaggcacagtgttttaggcaggaagttaagatatggggttatttgtagcaataagtggtagctttgaaggcaggaagctggcactacatttacctcttgtgcagttagtcatttgatcatagatttttttttgagacggagtccggctctctctcccaggctggagtgcagtggcgcgatcttggctcgctgcaagctccgcctcccgggttcacgccattctcctgcctcagcctcccgagtagctgggactgcaggcacccgccaccacgcctggctaattttttgtattattagtagagacgggttttcaccgtgttagccaggatggtctcgatctcctgacctcgtgatctgcccgcctcggcctccaaaagtgctgggattagaggcgtgagccaccgcgcccggcccttgatcacaggtttgcggaggcagataggacttgcacctgtaatatctgacaatttttgcgaggagaggagtcttcaatgacttgcagcctgaacactggaattgtctatcttcataattgcaatagtcgttaaatatgcctttgtttttgcttcaatgctcatttttcattaagatgcgtgtctcagccagtattttgcaccgccccagcgccaacatttaaggtttacaaaagctcagtactaaaaatattttcaatattcttctgacctgtctatggtctctcttccctctagagaaagggatgaggatgagacaggagaaatctatgattatgtttctactttttagcactttacaatggttcagcttccaatttatatgccagatattactaaatacagaggtaccgtactctataaagtaaatgcaacttaaagaagtaacttccaagagtaaggggaaaataaatcagacaaacaatgattttctactcaggcaataaaattaagaagggtacacgactcaagtcccaacaactgtcctaaaagtaaagaaactaagttggaaagagagactatggaatccattagaatatatgcattgactcatgatattttactgagcactgagttatcataagatttttccagggaagtgatctttgttattttttctttcattttggggttgagtgcaattttttgcttgcatattgaaatattaaaatacgttgctttttcggttattgctttgctcataaaccacccacagttattacagattctaattatttgatttcagtgcccagttacccccccgaaaatgtccaagccatagcaacatcaccagaaagcatatcaatatcctggtccacactttccaaggaagccttgaatggaattctccaggggttcagagtcatttactgggccaacctcatggacggaggtaagaggactaaactaggactttgggtttgcctccagagaatgcatgatggaatttgcagacccctcctagttcctaacaaggggctcaggatatggcgggcacctctttatcaatagacactttccccttttctgtcatccctcatctgacatttgaacaggtctctttgtttaaaacatcacacaccttcgaaacccaagttgaagcctaggcgggggcggcacttgggaaatttcaacatggatgtattttcctaattatgtctatgtcaaggctctgcaggcagcaccaaaacctccatctctatctagaacattctgtgtgatatgtattctaaaatgttggcctcttcctacttcccaaatagaactccgcggggaaacgttaaatttcctgtagttgtgctgtaagtgggtgtgggaagagtgcccaggcacatggaggggggcactcaggagggggccaggaagttcagggccctcccgttttgtctcctgtttctctttctcctcttccttccccttctcctcctctctcttttccttgttctttatcgtgtgtgtgtgtgtgtgtgtgtgtatttcaagtggtagggcaaaatgttcctgtttgtttagggcaaggctttgaataaacgactttctcaagtggacataagattggggccacaagtttcttgcagcaacacctcagtgtcttcgccctcaggctgcgagtggtgcccaccaggctgggccgggctgcgtgagtgtgctggggcagagcgaggctgcagcccccagcaggaaaggcctctggaagcctgctcactgtctctgtcccaagcctggggggcccacacctgcctcctcccctgccctccatttccagccccctcctgcaccccccgtcactggacagtaccttccctcttgtttggggtttcttttctttttttgagacagggtctccctctgtcacccaggctggagtgcagtggcacgatctcagctcactgcaactctccacctccccgggcccaagcaattctcctgcctcagcctcccaagtagctaggattgcaggcgtgcaccaccacacctggctaattttcagtatttttagtagagatggggtttcgccagcttggccaggctggtcttgaactcctggcctcaagtgatctgcccaccttggcctcccaaagtgctgggattacaggcgtgacccaccacgcccagcctggggcttctttcaacccctctgactgggtgtgatccctgatgagtgctcacctctaattttgggcaaatgcggtcaaggacctatcccttccctgctcaggaccacctggatctgttctaccaggcagacccctgtccccatgcaggtaaacatagggctccacaggtggcagcagcctccacggttggtgcaacagtaaaggcaagaagacacatgagcagcacaagcattactggctcagcgagcataggcctttgagccttagctctgcatgtccctaactgtgtccctaacatgtgtttctcaggactgagagcagacctcatgcctttgttgccacatgtagtacctggagcactaccagccatgggaggcaatctagaaggacccccccccgccctccttggtcctgcagtagacacatttgccaaacacccactcgacactgagctcatgggaaacaccaaggttgctgtgtctgtccctgtggaggttccagaccagtgaccgagggagatgctaatgaatacagaaccacagacccaagaagggacagccccacagaagggcagatttaagtagatgattctgtaacaccttcacccctcccacctaaacacaagttttaaaacaccccagagtaaagagcaatgaaaatttgcaaaagtcatctatttttatggacaaaataccataggatatcattacatatgtttcttctgatttctactccttatattgagtggatgaaattaaatacccttaatgttctttgaaaggcagtgttatgctaagatgtcttttctgttcttattggaaatatttcagaatccagtggtgacttcatccacatcacccatattttctaagctcactcacatttgctagcattgcctgctggtatcttcattctaaaatgaaagatgtggcttcatacctttaaagctttgaaaacttgaatattcaaaaacataattctttaaacaaagaaatgcttgggagtgtgcatgcagctttttaaagatactttcactcatgggattaaaatcaaagtgatgagataaatgtgcgatgtagaagtctgcacttcatttccgaaagataagcaagaaaccttcagaaacatgaacctgcctgcgaatggtcactcttcctgctacctgagagatttcgtttatgaggcaggtcagttcacggggctactggacacttttgcacaaactccccagactgcagcctccgggactggctggattcccacagacactgagcaggaagtgactgctgaccgacaccacatacacgtgcgcacacaccacacatacatgcaccccacatacaccacacaccacacataccacacacacacctcacaaacatcacataccacaccacacccacacatatcccacactcaccacacacaccacacctcacacaccccacatgcacacacaacacacatacacacaccccacatacaccacacataccacaccacgcataccacacacacacaccacacatacaccacatatcacaccacacacacatccctcatataccacacgccacatgacacacacccctcatacacatacacaaactgcatgtacatcacccaccacatgacacacactccatatacaccacataccacaccacacgtacacaaacaccacatacacctatgaaaggaaaatatctttttggcccccaaaatcactaaggaaaagtcaagctggaaactgctcagggccaacctgcctcccattctattcaaagtcacccctctgctcactgagatagatgcatatttgatggcctcctttggaaaggctgatcagaaactcagaagaacgcaacccttcccctctcacctacctgtgacctgtaagtcccctccccgcttcctgtcttcttgcctttgcttcaggttgtcctgccttccagaccgaaccaatatacttcttacctatattgattgatgtctcacgtctccctaaaatgtataaaaccaaactgtgccccgaccaccctgggcacgtgttgtcaggacctcctgaagctgtgttgtgggtacgtcctcaaccttcgcaaaataaactttctaaattaactgagacctgtctcaggttttcagggtccacataccacaccacacacaccccacatacaccatgtaccacaccacatgtacacaccacacatacacacaccacacaccacaccacacatcccacatactcatgcatacacacaccacacatacatacacacacacacaacacacactacacacacactacacacacaccacacatacaccacacaccataaccccaggcacatctcacatacaccacacaccacaccacacacaccccatatacaccatgtaccacaccacacatacacaccacacacaccacacttacacaccacacacaccccacatatacatgcacacacaccacacatacaccccacatacaccacacaccacaccacacgtacacacaccacacataccacacatacacataccccccatacactgcacactatgccacacatacagcccacatatactgcacaccacatacatacacaccacacacaccacacatacaccacacaccacaccacacatacaccacatatcacaccacacacaccccccacacacacgtaccccacatacaccacacactcaccacacacacctcacctacaccacataccacaccacacacaccccgtatatgtcacacaccacacatacacaaaccccacatacaccacacacactccgcatacatatgcacacacacacaccacacacacccccaatacaccacacactacaccacacatacacacacaccacaccacgcacaccccacacgcaccccccacatacaccactcaccacaccacacatcacacaacacatgtaacacaccccatgctactcacaacatatacctcatacacacagcacacacatacaccatacacacacaccacgcacacaggtacacacacaccatgcacatcgcataccacaaacaccacacacaccccccacacattcacacaggctgagaggggcaaatattgttactaccactgtaattagcaatagcccgaatactttccaaaatacgtctaagaaagaattctgttgttaatgtggtcagatgaaataaaactggttagtatatttgatagggaaggttaaataaacaatattttgatgaattttctgatttttttttcatggtcagaaagttaaatcatggttaaggcctgaaagaaacaatttatttgagattgctaggaaagttgtatcctttgaaaagttaccattttcctctgaatttttgctaacttccatctcatccatctttcttcatggaaaaaatggtacattctgaaaggaagcaacaattaggtgccaactggagtgtgtgggcagctgaggcttgcttcagaagctattcccgcacctattgttttctgccttaaaaccctctgaggatgaggcaagatataaatacacaaaactattttgtttaaaacaaaatttttaatagaaaaaatctgatttctaaatttattttatatatttttttaattttatttcactcatgacctcaactgaacaatacacttcagttaatgtgtgtgtgtgtgtgtgtgtgtgtgtgtgtgtgtgtgtgtgtgtgtgtgtattaaacagccctacagaggcatgaaagctagactgtagaaactcatgtttaaaaagaaaaagcgttaaaaagaatggcaaactaaacactcagttttgtatctggctttcttctttttcattctttgctttttatttcttccatatctgctagtcacctagtatctgtcatcaggaaaatagccttccttcacagcctatgaggcgttctagcagatagagccaactgtggctcaggtagttttagaaatcttaaaattgggattttgactgcctttgtcttcatggttcatgataaattagttaatcaaaataacttgaaccccccccccaatgttaattctaattagtatattaaccattagcatttttaatcattttgttttaagtgtttgcttttttttttttttttttttccttgagacagagtctcgctctgtcgcccaggctggagtgcagtggtgcgatctcgactcactgcaagctccacctcccaggttcacgccgttctcttgcctcagcctccccgagtacctgggactacaggtgcccaccaccacgccaggctaattttttgtatttttagtagagatggggtttcaccgtgttagccaggatggtctcgatgtcttgacctcgtgatccacccgccttggcctcccgaagtgctgggattacaggcatgagccactgcaccgggccaagtgtttgctttctttaagaagatcagagaggccaggttgtccttctccctccccaccaggctcctcttcctcattctgtctgattcaagagttgcattctgattcaagtatttgccggagggtcacagctttctcctatattgtgaaatgatcctactttttctgtgaggtggacaccctgcactcttgggaaaaaaagaccttcatcagagtctcataaccagctaccagcaccctgccctgatcagcccctcccctcagctgtatttttattgattgcgtgtgtatatatctgtagggaggtacgtgtgtgatctttgacagtgaagtttctaaatctgaaaagatcttaatgagttctatatttaaagtttgtccattagcatatgagtttttaattagtttgtttaaagacagggtctggctctatccttcaggctggagtgcagtggcacaatcacagctcactgcagcctccagttcctgggctccaccgatcctctcaccttgagctacttgggaggctgggaccacaggcatgagccatcatgtctggttacatttgggtttttatcctaatccaaaagacttatgttaaatatattcaggaaaaggaatataattgaatatggaaagacccgtccttcagagatgagaatttccaatccatctgggacaaccaagtattgatattttgactacctggtgaccacacatgctcacacagtctcctcattttcgtaagccctccgttgagatttccaaattgtgacctttaacagctggcaccctgctggcctccctagaagacaggagtccaaaggcctgtctttgggccatcctcgccctgctccctccccagcaaagccccagcctacagaactgtctgcttctggtgctcccaggcctttggctcccactggggcctggactgtgggagccacatggagcccctttacccctcttcttgcaactcctagaaggcacaggggctctctggcatgtgagggacaggcctcagccatcccatgcagtatttgccatgctcctttaatgctgtatccgttccacattgatctttttggtgacaaaaaaaagatgaacaaaagatgttccacagtcatcgtaatcacaaaatacatggctattcatttgtgaacctccatgcaatatcctggacacacaaaatacgtggctattcatttgtgaacttctgtgcaatatcctggacacacaagagaaaagaaaaacaatgagcaggaaggaaaaccaagacaggcaaaaagcaaaagcccgtttaatctggccgacacgacggctcgtgggtgcctccattttcagcccattttctgctttttcccagagcgactgaggagagcagctgagatccgcggcctgtgccctcagccactgtgctgggctccttgatcctctctgtccctcgacttccttgtctgtaaaatgaatgggttgcaaaagtaattgaataactctgctggttgtataagttactatctgtacttagaatagcatagcgctggcacctaggcaggcatgcatatcacatccactccctatatggaggccagggagagtgagagggattgacaagcagctggattgtcagttgacgagcaggtctgccaaatcagagctgttcaacaaggaactccccagacctgctggtctcttggggtaaccggcctgctctgggtaccaatgtgtcgctgacagccccttcccctaggggaacagttctcaggcccttctcatgctctgaaggcgactcatttcaaaacccatcagccaaacaccaaggaagtacttagcacaacattcgtaagttttctcaaattgccgtgtatcatatgctggagttgagagcgcatagtgttccatctgtgaatgttattagttgatcccactcctgaaagtgaagcatttttagctgacaccaagtttctgacacatgggcatgtcacttcaggattgaagctgagaggagttcactccaggtaaaaagaggggttggctgagccactcagtttagctcaggtgtatttttttcttatttaaatatgttatcttttcagctttattaaggtatagttgacaaataaaaattgcatatatttcagacatgcagcttgttttgatgtatgtatccaatgtgaaatgctcgccacaatcaagcaaattaacagcgggtccaccatctcacatagttgccattttcttcctccacccccaaatgatacaaagtttcagttatgcaagatgaataagttctggagatctaatgtacaaagtggtgactatagttaaagacactgtcttatagacttgaaacttgctgaagagggtagatcagatatttgggatgaagttaggtacttaaaaatacatgtatgttaaagtagagcttgtttaaaataacaataaaacccctcagcttgcagaagcttcctaatgaatagtcggcagtggggctgccaagtgtgcagcgtgtgtgtgtcgccctaagtgtgctgctaggggtgcaggggacattgctcattagcacctgctgaagggtgagtggcagccctggtgctggccttgggttgataacacttaacttggagcgaattacttcgttttccagaccaacgttctgccttgtgttctggagcagtttggtgtgaatgttcttttccaaagggccacgtgacaccatgagctcacaggatgactgtgcacagtccctttgagaattctcgtgtccagatgatggctggacgggtgatggcatggcacagggacagtcagtggggacagtgcggaaaaacgagcagaaatgggctcagaagtgggattttgttttcttgttcttgtcctccagagctgggtgagattaaaaacatcaccaccacacagccttcactggagctggacgggctggaaaagtacaccaactacagcatccaggtgctggccttcacccgcgcaggagacggggtcaggagtgagcagatcttcacccggaccaaagaggatggtgagagacgggtgggcggtgggtcccagcagttgctggaagggctgggtcacagagagctcacttgcctttaccctgcagttcatcaggctattctcagtgcaaacctttgctgccctcccaaaatatcccagtgcaattcagaccattaacttcctctcttgcctttgcttgatgtgtctaatccattgcttcttcttcctctatattttttcttctttcttttctttttttttgttttttgttttttttggccaagtattattgtaaatagaaactcattttatcctagagctgtaatacttgtcatacatgttttgtatcttgttagaataattttagtagctattcagctattagtgtaaactctgattaaatccatccttccacttcttgaaaattatgtacagactgaagttctattattctttgccagctgaatcactttagaataagtccttaatttgagaacttcatgttaattttttttaattcttgcaagaattcatggtgatttagtaaaaatttaaattgctgctcattttgttctacaacaataattcttgctgttccttacaatttggattgggttgtgactattacccaaacgtacaaaaaccatacaacaaaggttctgtattattttaagggaaactctgaggggccttggccaagcctgtttaaggaacagataagttctgataaatactaccgtggtagtgagaaaagtagcctccaccttaataaaggaaggagcaactgatgtcaaattgatgcccacatagaaccttcccaaaatattccagcacagaagtatacattgagatgagacattagcagatctaaatgctgtgctggattgtctctgcaacttttgtcttcttgccgggactctgttccccaagcagtacaggggcgggaaagctgttggccattgctggtcacctcctgtgtatgggcaggtttgatgtctatgctatctcccccactactagagtatcaaaaatgctgttattccatcccatatctgctctgatggaagcaaagaacacctgctcaggggccatgatacgctcttctcttcagcctttctgcccctgacaatgactccctgttattctgagcctgccatcttccacgtcactctctgctctcaccttggcaagccaggccttgctcctccgagcagccccaggcatccactctcacctggtgtttttgctgcctctgtagcccttctcacattgtaatgtctacacccaaactaatcctcatttgctttagtttttttctaaaatgcacaggtagtccttccagggaatgtgcaggtgtcagccagttctgctctaagaaattggattatttagggaatctaaggttcaaatgtaatgccattaggaagtcacacatcaatagagatatctagaaagctaagtcctgagtgaaggcagccataagttaattttttaaaaatgtaacagacaaacagctgtgcaaatgctggctctgtcacctgctgcccgtgggtctttgggcaccttacctaagtgtctctgaactggattgtcctcagggacaatctgctgtagccatcagactgcacagaaccagtgtatgagagctgaagtggtgtctgaaaacacctgcttgccacagagtgggatgcttcctgaccctcaatatttgattatttgctctccactccttcagagtaggggtgaaatactcctttttacattgctaggcaataatgcaaatgtcactggaattattatttaaagagcaaattgatcatccacaaaatgttttgcatctgcatttttggaagaatgtacagaaatccaataagaagggaaggctcttcacagatccttattaactcacaattttagatcaatttttaattaatattggagttttaagaatcatggagttctgtctcaaaacttgaccccaaggcccaaggtctaatttgtcaatcaattatgctttgcttttgtctccagtgctgatagtgtatggagctgggattgactatcgaaaaccctgccttgggtaccccagttaccccaaggaagatgccatgaatcccacttttgctggtggtatgggacaaggactatgcagaactgagtgtcaatatttctttaggataagtctgcattttcaaaaagaagtggagtggtggatcgcttgaggccaggagttcgagaccagcctggccaacatggtgaaaccctgtctctactaaaaatgcaaaattagccaggtgtggtggtgggcacctctaatcccagctactcgggaggctgaggcaggagaatcacttgaacccaggtggcagaggctgcagtgagctgagatcgtgcaactgcactccagcctgggtgacggatcgagactctgtctcaaaaagaaaaaagaggtggagtgaagattgggtggaagaagagaagaactagaataatatcacttcatctcccaggttcacatgaaaaattcaataatttagaaacggtgaagaattgtgtcaaccacttttgtagactcaatacctaatataattaggcatttcagcagtttacagaattaaatgctattttatttatctgattggaagaagggacaaaggacaattcagagaacaaatgcccagtcaaattgattacagatcgtatttatacttcaatgagaaagctttgtaattttgaagtttggattacacttacaatttcaattaaattgtgtaaaaatacagatagatttccagtaaaataataattaccaacatttgctcagttctttctcaataagatactattttaggctcaggttgaagtttcagcgtttatcaacgttcttgcaagcgaagaaagatagctacattaacagcgagcatccgattcagttgtctatgccagacacacgtcctgtaccagtcttcctaatctagggagcctggaggcttaaactgtgttattaggtcactggtcatactaaaaagagaaacttaaccctaataaaggcaaaattgtacttttgcaagggattatttgcaatagaaatatttgtttagaggacaagtctgtgcttgttctctacaggtagtttctctaccactatctaaagattcttgggctcatagtcatattcacagttccatggacacattctcatgtctgtggtcataatctcagggccatggacatagtctcttatccataactatagtctccggtgcatggacatattctcatgtctgtggtcggagcctcagggccatggatatcatctctcatccgtaaatagagtctcaggtacatggacatattctcatgcctgtagtcagagtctcagggccatggatatcatcttttatccataaatatagactcaggtgcatggacatattttttggggtctgtgactactgctcacagttcacgttctctttccaggactgctctatcagtgagaacttgtaccccattattgctgcagaaacacgaaggacgacttggtgatctggcttttctgtttttgagcacaacagcaactaaacctgacttctaaaaacagttgtgaaatcctgatgccattttatttgccaatactataatacgagtcaagccgtaaggaaagagaacacaaacaaaatgcaatctattaatcttccaattgctgttttcactctgaaggcaaaagctagtttcagccttgatccctttacacaagagtaaactttgcatatgtatcaatagagatagttaagttcaaatatttactgaacacatcactaatgcacctaactctgaaggtacatgtgagagggccagcagcaggtgtaatatgtgatctctactccctccccaccatcaattagcaatctcattgggaggagatctgaaagtagagctaagaggaagcaaaaaaataagctgacatctggatacctctgaatcttctgaccacccatactttgagccatacatacttgtgaaggtgtggatagtgtgtgcctgtgacgtgtgctggggtgactatgtgaccacacctcagtagacctgaaagggggtagattgcatgctatgtttgcatagccaccagtggtgctgcccctcagtagacactgggaagtactgccaatccacactgctcaagattccagtgctctatagcctatggtagtgtgccatgtgcagtggcaggtataccagcaacacgacagacaagatgtcctagaagagattctaccatgtggctttccacactccctccactgcagtggatcccaaactaggttcttacctcaaactaggtgggcctcagcagtgcccagtggtaagcaagaggcccagtgggagactccattctctccctgaccccagcttcaagagccaccccacttccacttgtgttatgtgctgggtttccacatgatgatttggttaaaggatcagtcaaacatttaaagaatgaacactcttgctctagtgagaggaaaggccaaaaatactagagtcttatggacatgggaagagaaaagggacatatgtgcatgcttggtgggatgacagctgtgaatgtgacatgtccctccaggatcgtagcatctgcacggcacggcatggctcaggaaaagccactgaaaagttgtgggttcagaaggatctggctaccatggtgtaccacatatgtacatgcatgtttgtgcatgcacaagtcacacacacacctgcctgtggctgtttactaagaccagaaaaatgatggtgaaaaaaaatgaagctgactgcggtgtctgtgtgggtgtttagtcagacttttgtccgatattcatacttcaaaacaaggcaatactgtttcagaaaaatgattgtggtatttttacattaaggtatgttacaggagggcttacccacttgtatttattttctatgctgtggaacagattgctacaaccttaacacgttaaaacaatacaaatgtcttatctcatcgtttctaagggtcaggcatccaggtctggttgagctgagtcccctgctgagggtccgacagatgaatcacggtgtgagctgggcctgtgccctcatctgaggtcaaggtctcccaggctcacaggatatgggatctttttttttttttttttttgtttggttatgaggctggagtcaccagcttccagaggctgcctgttactccctgtcacaccccctacagcatggtagcttccttcttcaggaccaataggaaagtctcacatggcttccaatccctctgacctcttttgtctctgacctccatctcctcttctaaggggcgcatctgattaaacccagcccacccaggaaactttccttttcattaactgaaagtcaagtgattagaacctcaatgatacctgaacaagcccttcacctttgccacatggcacaacctgcccatgggaggaatctgtccatcatagtaacagatgccacacccattcaaggggaaggaatcacccaggcacatacactagaaggtaaggatcttggggacccattgtagaatcctgcctaccacacagacacgaatgaaatcatttttccactcttggaaaatctgtattgaggatctagtatgttccagatactggcccaggaactaaagatgcagagaaacaggatgggcatggtggggtttgcaagctagtgggggagacagacgttgatagatcacccctgagtggactgtgtcaagtgcaatgatgaagaagagtctcaacagagacatgggagccctgacctgacctaagctggtgatcagggaagacttcctggaggaaatgacgtgtgctagaacctgagagatgagtaagagttgccaggaagaaggcagagggtgggaaaaactccagacagaggcatcccaaggccctggatcatggcatcccaagggcccggggtgggagaagcaaaccacgttcagggaactgaaacagagctcagtgttggggagcaccatcagatcagggggagagcccaactgctgacctgtcctgtccatgtggacctccaaagggcccatcaagtgacagcaggaagagaattccaggtcctggttcttgcaactgagaagatgatggggccatttcctgagatggggcaagagaagcacaggtttggatagaagatggtgagtgctgttgtgactatgtcggtctaaggtgcccgtgtgaaacatctcagccaattggacacatgagacacagaagcatctgcagctcagaagggatgtccaggtgcattggaggaatgtagaagagaggattctctgaaggccacattctttactgcaatcaattaaacttaaatgcagaactcctctctatgatgcccaggaattcatgaaaacttcccaagtttgttttgaccttcataagaaaaactcagattaccaaaatggaatgtggtcactaagaatgtttcaagaaaatatgtcccagacagacatataccgttttttactccatcctatgccatctctgtcttctgcaactctcagtgtctggtgtttgtcattcaccactgagtcacaaagtaaaggctagtatcatttagtgacatataatccaaggacataaggatggttattagagatgatagctagaacttatttggtgcttactgtacagagaacaataaataaatgatttacatgaattatctcttataattctaacagtaaaaacataagccagcacagttattattgtagatttataaatgagggaactaaagattattagagaagttaatcagcttgtccaggacgtggaactaagtgctagagccgcatgaaaccagcagtgaggctccagggcccacacctttaagctttatgatgttgtccaaaccagaactaaaatgttaagttctagctctgaaaagattagctcagtcatccagaaaaccttccaaaatgccgtgttcttcaacttatctatgttgttattttattgtacaaagttctagtaaccatacaaggaaagactgtgtaagatagatcataaatccatgcaggaggagccaactgcgagtttagatggtgcagtaaaagtcccttgatcggctgtgacacaggcatgctcacggaaatcatcacttaaaacaaggaatcaccaaactttgcagtggccaggaagtacctgaaatgttgcattttaacttaaaacatataaatatgtatttattccctaatcattctctaatcacatgacttaggatcacttcttgaagttttgggtgaaaagattggagctctgtgccatcttttactccatgaactgcatttaatgtgtagcatctgcatttttcaactggtgtctcaagtaagagcatgtgaccatttaccaacgatctgtttgcaaattgggacaaatccacatgtcccattcttctcagtggtcctgaccaaacatagatcggccttcttctttctttcctttcttctttccttcttttcttctttcttttcttttttatccttctttccttttgtcttcccttcttccttccctccttccttccttcctttcttttttcttccctctttcctttcttccttccttccctccttcattccttttgttcttccctccttcatttctttctctttttaatttcttttctaacttacctctaaggaaggctttccaaagtagtcccattaactgtcatagaaacagctttctcttgcacttgaatttcattggtttacgtaattaattaacttacagtactacccatgacacgtacaattgtcacaaacaggttggaaacaaatacaactgactcctcttcagcagccattcaactggttggtgctaaactacttggcctcctaaagagaagctgtccagcaagaatgttcactgtggtgaacaccaaccaggggctttatggaaaggactgagagtgttggctaagctggggtgtctactaggattaaaatccccaggaaacgttcactctgcccttgttgttcaggaggaaccctggcagctctgaactaggttgtggatgtcttagacattaccctcacctgatagaggtttgttctcaagggattttttaacccaggatctatcatttatgtgtgttaccttttctagaccttccactgttagcaagacttgccaaaaatggattaccaagattttatattttcaaatggtgactatgtccaacccaagttagttctcaccagagctcttggttttgttatgcagacttagaagagtcaaggtgacgattatgagaagcacattcaactccaaaacaatttactgagcagttgcattgccatcaaagcagtaaaagactcacagatttctccaggggcttgcaagggacttctattggtttgaatttcaatgtctccatcaatgtggttgccctccatatggacagtgaggttaatgagaaacaaagcaagagctctgatgccttcctcactggcacctttgacattttggcatcttcttgtcttggccatctcacccgccctcacctcttcaacctggaaaataaaagaacaagaggagtgggacatgccttcaatctcactcccaaatcatgcttagtattgctgccaccatgttctgccttcttagctggtttacagaggagagtttgtcttacatggatactgtgaatctttgacccaataatccctattcatcaacaatatttccatacctctcctgagcccaaagtggtgccattacaaaatgactagggtgagggagggtggggtctctgatggctgaggtagttcaccctcatgcttctcaaattcaggatccaaaaggttcatccccagtacattcaaagccaaaaactgcagcagaaatgagactgatccagaagttaattctccagttatccagaggcaggaagttgccaggggctgaaatgggttgggaagactccccaggacaagagggactagaactgactgtattaggtcctagagctacaaaggaccacagactccaacattaggaatttatttgctgtctctgagttctggaggccagaagtccaaaatcaaggtgtctgcagggctggttctctttaagagctttgagacaagcatctgtcctgggcttctctccttggcttatagatgccctcttctccctgtgtcttcacatcatcttccctctatacatgtctgtctctgtgtccaaactggccctttttataaggacaccagaagtactggattagggaccaccctaacaaactcattttaacttgattacctctgtaaagaccctacctccaattacagtgtcattctgtggtcctgggggttaggacttcaacatatgcatttggggggacacagcggaacccataacgctcatcctgaaagagctgaacagtaagtgcggagtggggtcatgttgggaagcgtgggtccgcaagcccaagttgaggccccaccttgtgactaaacacacggctcttccagttccaggtcctcccgcgggtgtgaaggcagcggcggcctcagcctccatggtctttgtgtcctggcttccccctctcaagctgaacggcatcatccgaaagtacactgtattctgctcccacccctatcccacagtaagttggtaaataaccaagtgcctttcaagcgtctgccagggacgagctgcaggtgctcgcactggacagtttcgttcctttgtttcccacctacctgggtctttccagtggttttgttttgcccctgctgtctccacatacaaaacaaagtcctcatttacacctcatttgaaaatacgctcctgaatcatgacaagggggacaattgtctggaattattgtttatttggtgagttcccactaaactgccagcagcctgatcaaaatcaaaacccagaggccttgattgtgccttaattgatagtcagtggacaacacctattgattttactgttggactcatcatgataagcacttcacgccttccctccctcccttctccctccctccctccttccctccctccttccttccctcccaccctatccctcccttctttccctcctccatctctcacagggaaaagaatagcaggcaaaaccctattgtgctagaaatgagggactttaatgaagatctattacccttacagttacagcagtcagcctggttcattgtgaaggaactaaaagttatttactatttcaaagtgtggtttttgttatcgttcatattattcctgctgaataatcattataaagttagactgcttctgagaccacaccaaaacatatcaaaaagggaaattttaaagaaaagaaaacattaaaatgacccaccaaaattgacgatgtcttcatggaaacattatgacattttctgcagcaggtgccatgtctcttccatctttgtatctccagctcccagcatagaacttgacacatgtagtcattcactaagcgtttgttgagtgaatatacacactggttttgtttcctttctggtaaaatacacataacgtaaaacttaccctcttgaccactttgattattgagttcatcagtattacataccttcacgttgttgtgaagccatcaccaccatccatctccagaactctacaaaaccgaaactctgtccccattaaacacgaattccctatcctccctcccaccagcccatggcacccaccattctactttctgtctctggatttgactcctctagggacctcatgcatgtggaatgatatagcatttgtcatttagtgaccagctcgtttcacttgacatgatatcctcaaggttcatccatgttgtagcatgcgatggaatctccttccttgttagggctgaaaaatattcccaaacaaatttatggattaatcttttaatcaaggtgatatgtttgcccaagctcagagtccacaggtgcccctgaggcctggtgtaccccaacagtgagtgtgtgagagtgtgtgggcttgcttggcccatgaagttccgtctgttgctgaaaaagcaaggtgtgttctctactgcttatgcattcatggcagtactctgcccttgaagtcaatatgtaaacgtaaatagtcagagttagactccacaacatttttctgggcttcttatgtggttttcaatatgctgttaatcctcacttactgaatcctactatcaaagcccagagatggagagcagcgtagacactgaaaaaaagctgagccattgtgccctcaatgcccagggtggcttctgcttttctgcttatcactgacatgtcccgtattcaccaaagagagacaaaaattattgctgaaataaagtatactcattttccactagaacttgaattgcatctgtattagtattcactcattcattcattgatctctttgctatgggattcacggttgctcttttgactctaacaggctagaaagcacctagcagggtatagaaagaccagcagcttcctctcgttttgtcttctcaatcatcttatctttatctctgcactaaaaatccctacctggcttacttgaaatgagtccttagtgactgatgcttactgagaaagcccctatttgtggatgatacaggctgtatttggctctgtcctcctggcctaagaattacatacaatagaaaaggaagaaaaaacatcctatcctgaaaacaaagtcacacaggtgttgttagatggggtagaaacgcatttccccaggatttctcctgtctcttcacccacagaacaatgggatttgacctgcccaggatcttaacaacacactctcaaaagggacagtaatgagggccagcaaggcacggtggctcacgcctgtaatcccagcactttgggaagccaaggcaggaggatcacttgaggccaggagtttgagaccagcctggccaacgtatgaaactccgcctctacaaaaaatacaaaaattagccaggtgtggtggtacatgcctgtaatctcaggtacttgggaggagctgaggcaggagaaactcttgaacctgggaggtggaggttgccgtgagccaaaatgtcaccactgcactccagcctgggcaacagagcaagactctgtctcaaaaaaaaaaaaaaaaaaaaaaaaaagacagtaatgagagcaaacccaccagaaaaaggtgggaaataacagctgagatttttatcagggtatctctgtgttgccttttgaccatattaaaaagactagagacatagaaatatgatgggcaggtgcctgtgttcttccaggagataatacctagaaagtgttacaaggaggtcccagaaccccagagcatcttaattgaagtgaagtgaactaaaaacagttccctctccatatccaccttcctgtctatctatctcaaccatcatttaagagcacgagacctattttttacatcaaatagtatcagtgagagtcaagctcagagacaattatttctcttcagaggtgaatacttgtaaatagtatccattattctgttttaaatatgaaatgatcaagaaactttaaagtacaggaaagagggtgtttttttgttttgttttgttttcatcagtttctgcaatttgactttcagtcggtaaactagatgctgtcaagttttccaaggcatttgcatttctggctatgtgtgcgaatgaccaccagaggacagtatgagctctagatattttccttgctcataaatctgaatttttttttctttgaaatgatttcatagttaaatgtagaacatagggggataaatcaggacacaatatgccttgtaatttggtcccttttataagagtccctcagctaacctcctcgctgatgtcattttctctcaagatcccaaattcatctccccttcttgggaaagaaccctgttaaaatagacaagcttttttctctaatatgtgacatataatgtctgctgataggcatttatttcatggtgctctctcagtttagcttagaaaaagacattagaatttgaaacttgcatgtggccagatgacaagttagggtaactgagaatgaatctacaaacaggttgtctaaagatgatgtggactgaacatgaactttccctcgggggtccaacagtgcaatgagatattaaactccccaatcagagattcaaactgcaaaatctcaaaagtcatttgattcagagcctcatccacataatttgtggattctggctattaattttaatatatagtggtttgaatgatcaaacaatctattataagcaatgaaaatccaaagacgtgagataacccttttaaggtcccaggaagaaaacagccaagcttcatttcctccccaacgctcccgtctacataaaagcagtctgaaaaactttcacaaacagactgcttttactatatacacattaaataagcattatgatatagacattgtctgtttcacaatgctaatctcatttgcggagcttagaaatgtaaaattaggaagcacagacttctcattaatgaaaactaaaaatcagaaggcataaaatatctctgagctgtgattcacattggttattccagcttcagatgataatgttattcagttcctgtacatagtaggtgctcaataaatgttgctgagttaatcagtgagaatacaccactactcttcttacccagaagacctgggcaattaagttctccacattgtagcccataacttagaattaaacaagtcttctgggaggcaaagtaactcaccaggtccagacagcttcccaccccaggcaacaggtgtgtgtttgcctcccaatcagccacagactgcatcaaataaagccatagtcaggctgagagcgaaaggggacttccgagaaccagaaatgtgcaggaatctcaaggagtggaaaagtggtataacgtggaatctggaaagcagcatctaacgtgctcatctgtatctacaatgatactcatcgctgtgttcattcttcctctctcacacggaacacggacctcctggctgtattaaaacgtcgttcctccctcccagtaccctccctatttcatgtcactgtagcatatagtgacgctactagatagcaatttgcttttaaaatcctccttctcttagcttccattatcatgttttttattctttgttgcttcttgtccctctgcttcccacccttaaatgtaggcatttcccaatattcttcctttatctcttaatattcttcactatctctgtggatcattgaatctgttcttataatgtaactatcatctgaaattaaagagttcgcattttttatctctatcctgacaatcttagagaaccgtcagtcctatatttccagcttaccaccatctgcgtactcaggaagacctctccagtacttcgcattcaatgtgcccacaaacacatttatacttgtgtctccctcttttcctgtgttctgatttagcttacgatctaacaaaatctgctgccttctgaccagaagccttcaagctacctatagttcctctcctaatcatttattcatttttaccacaaataaacatagagcactactcttacaccaagctctgagccaggttctgaatcacatcaatcaagagatgctgagttagggggcatcacaaacaggcctgaaacctcagtgatttacaacaaccatacaacaaccaatggttttatttttctttcacgatcatgctcattgtgagtatgtggtagtacatgccatgctatcttcactccaggaaggacccaggcaggtttcatgacaaagagaaagaaatctctgaggcgctgacataggcaggtaaacgctccaagcacaaatcacgagccagaatctgtcataagattctggtccatgtcttaaccacaaagggaccatgacgtacgctccaaacccatacccagaagttccagggaaggcaggaaacactagacaatgtcacccttctgtgtgatgtgacagaggacacagcaatgatgtgcacagcacagtgcaggagcgcggactgggtgtcactcaaacatacggccagagatggttgcttggaacacatagctagccctggcttgcaggaagagaagaattttacctgatgaatcagaggcaggaaagggtaatatgatcagaggaaataaatgagcaaagtgacatcatgtcacaagagctctctgcaatgtcttttttgttgtttgtttgttttgagacggagtttcactctgtcgccaggctatagtgcagtggcgcaatctcggctcactgcaacctccacctcccaggttcaaacgattctcctgcctcagcctcctgagtagctgggattacaggcacccgccaccccaccaggctaatttctgtggttttagtggagatggggttttcaccatgttggccaggctgctctcaaacttctgacctcaagtgatcggcctgcctcggcctcccaatgcaatgtcttcttaatctccttcctttcacacccaatgccattgccttgcttcaggtcctcccctggagaatcaaaaccaagtcagaagccttcccactgccaggctcaactcccagtctgttgtccacatccctgtcacaattcctttttccaattctgaatctgagcatgttatttcctagtgcaaatttattggatgacttcgcagtttttacctaaagacattcaaaattctcaatatgacctagatagatttccacaatccagctgcatctcctgtctagtttcatattctaaaaaccttcttccatccaatatctaagtaataccatgtctcatatgtgtctgcatttgtgcacgtgtgtgtatgtgtgtgtgtgtgtgtgtgtgtacacgtattgggtttttcttaccttttccattccatcctctttggtaaaaatgtttattgtttaaagctcaacttaaatgctgtatttttatttcaccactttttatcactggctacacattaggcaccgagtgccaaaagctttatacctatggtttttgaacttgccctatggtgacccacgatagaaaatataagttataatcacgccacgaaagtactcgcacaccacaaacttacatttactacacgtgatgccctccgatattttctgttccatttgactttttttctattctatttcattttgtttttaaagtgattgtcatgttccattaaattcctcctatgactcacatttttaaaaatactgttttgcatcagttaattctggtgactaccttacgcaggaggtgttatgattgttatcttcactcagtgatactgaaatgaagactctgcaatctggccagggtcacgcaggttagcaaaggaagatgggatctgcaacccacagcgggctgagctctttgtcctcatgcttacctgccttccctgggatcccagttccatcctgccccagtactcccagcactgactttcaacctcactttgacataaccacaatctcttgcgttattgttagacatgggcatagactggcaaacctggtattgtgctgaaatagtggatgttcctcaaatgtgtgttgaattaaattttatagatgatgactgtgagtcatctaaaagaggttaaattgtgtaatgaagctgtagcttaataaggcaagaaattgtgttatgtactttgggatgctttgtatcccagaaggatttggatcaagtgcctgtgcttttaaatcacttacatagaaatcattcttccatcattttatttaaatgacttaaggatgaatctttttttttttttttttttttttttttgagacagagtctcactctgtcacccaggctggagtgcaatggtgcgatctcggctcactgcaaactctgcctcccgggttcatgctattctcctgcctcggcctcccaagtagctgggactacaggcgcccgccaccatgcctggctaatgttttgtatttttagtagagatgaggtttcactgtgttagccaggatggtctcgatctcctgacctcatgatccgcccgcctcggcctcccaaagtgctgggattacaggcgtgagccaccgcgcccggtcgaatctctctctttttttttttttaataatggaaaatctgaaaattatggagataccacaagttggcctaaaaatagacaattgtattccatttacgcacatgtaatgaatcatatacatgagacctttgtgcagtgcttctacatggcaggcagatgctaggctctctatgttcttggatcaaccaaggattactgtagccccagcatcctgtcatggaatcatacggctggaaaaaacctcgaagggtttctttgaggcaaggctacatctaaatatcccagacatgtgaaaatcaattctggttttataaaatttcttgggaagtctattcctgaagctttcttggaaatatctttttatttcacggctagttctaatggaatgcagttcgttattttttcacttttaagttcaggggtaacgtgcagatttcttatataggtaaacttgtgtcacaaaagtttgttttacagattatttcatcacccaagtattaatcctaatacccattagtagtttttcctgatcctccccctcctctcaccctccaccctctgaaaggtgtgtgttgttgttgtgttgtgtgttgttcccctctatgtgtgtgtatgttctcataatttagctaccacatacaagtgagaacatgtggtatttgtttttctatttccatgttagtttgctaagaataatggcatccagctccatccatctctgcaaaggacatgatcttgttctttttcatggctgcatagtattctatggtgtatatttatcacattttctttatctagtctatcattgatgggcatttagattgatttcacatctttgctattgtgaatagagctgcaatgaatatatgtgtgcatgtgtctttataacataatgatttctattcctttgggtatatacccagtaatgggattgccaggtcaaatggtatttctgtcattaggtctttgaggagttgccacactgtcttccacaatgcctgaactaatttatactcccatcaacagtgtatgagcatccctttttctccacaacctcaccagcatctgttattttttggctttctaataatagtcattctgcctggtgtgagatgatatctcatcgtggttttgatttgcatttctttttttttattattatactgtaagttttagggtacatgtgcacaacgtgcaggtttgttacatatgtatacatgtgccatgttggtgtgctgcacccattaactagtcatttaacattaggtatatctcctaatgctattcctcccccgtccccgcaccccacaacaggctccagtgtgtgatgttccccttcctgtgtccatgtgttctcattgttcaattcccacctatgagtgagaacttgcggcgtttggttttttctccttgcgatagtttgctcagaatgatggtttccagcttcttccatgtccctacaaaggacatgaactcatccttttttatggctgcatagtgttccgtggtgtatatgtgccacattttcttaatccagtctatcattgctggacatttaggttggttccaagtctttgctattgtgaatagtgccacagtaaacatacgtgtgcatgtgtctttatagcagcatgttttataatcctttgggtatatacccagtaataggatggctgggtcaaatggtatttctagttctagatccccaaggaatcgccacactgacttccacaatggttgaactagtttacagtcccaccaacagtgtaaaagtgttcctatttctccacatcctctccaacacctgttgtttcctgactttttaatgatagccattctaactggtgtgagatggtatctcattgtggttttgatttgcatttctctaacagccagtgatgatgagcattttgtcatgtgtcttttggctgcataaatgtcttcttttgagaagtgtctgttcgtatccttcacccactttttgatggggttgtttgtttttttcttgtaaatttgtttgagttcattgtagattctggatattagccctttgtcagatgagtagattgcaaaaattttctcccattctgtaggttgcctgttcacgctgatggtagtctcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttagatctaacatttaagtctttaatccatcttgaattaatttttgtataaggtgtaaggaagggatccagtttcagctttctacatatggctagccagttttcccagcaccatatattaaatagggaatcctttccccattgcttgtttttctcaggtttgtcaaagatcagatagttgtagatatggagcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattctatgaagaaagtcattggtagcttgatggggatggcattgaatctataaattaccttgggcagtatggccattttcacaatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcagttgtaaatgggagttcagtcatgatttggctctctgtttgtctgttattggtatataagaatgcttgtgatttttgcacattgattttgtatcctgagactttgctgaaattgcttatcagcttaaggagattttgggctgagacgatggggttttctagatatacaatcatgtcatctgcaaacagggacaatttgacttcctcttttcctacttgaataccctttatttccttctcctgcctgaatgccctggccagaacttccaacactatgttgaataggagtggtgagagagggcatccctgtcttgtgccagttttcaagggaatgcttccagtttttgcccattcagtatgatattggctgtgggtttgtcatagatagttcttattattttgagatacgtcccatcaatacctaatttattgagagtttttagcatgaagggttgttgaattttgtcaaaggccttttctgcatctattgagataatcatgtggtttttgtctttggttctgtttatatgctggattacgtttattgatttgcgtatgctgaaccagccttgcatcccagggatgaagcccacttgatcatggtggataagctttttgaagtgcttattcggtttgccagtattttactgaggatttttgcatcgatgttcatcagggatataggtctaaaattccctttttttgttgtgtctctgccaggctttggtatcaggatgatgctggcctcataaaatgagttagggaggatttcctctttttctattgattggaatagtttcagaaggaatggtaccagctcctccttgtacctctggtagaatttggctgtgaatccatctggtcctggactttttttggttggtaagctattaattattacctcaatttcagagcctcttattggtctattcagagattcaacttctttctggtttagtcttgggagggtgtatttgtcaaggaattttaccatttcttctagattttctagtttatttgcatagaggtgtgtatagtattctctgatggtagtttgtatttctgtgggattggtggtgatatcccctttatcatttgtattgggtgtatttgattcttctctcttttcttctttattagtcttgctagcggtctatcaattttgttgatcttttcaaaaaaccacctcctggattcattgattttttcaagggttttttgtttctctatttcattcagttctgctctgatcttagctatttcttgccttctgctagcttttgaatgtgtttgctcttgcttctctagttcttttaattgtgatgttagggtgtcaattttagatctttcctgctttctcttgtgggcatttagtgctataaatttccttctacatactgtcttaaatgtgtcccagagattctggtatgttgtgtctttgttctcattggtttcaaggaacatctttatttctgccttcatttcgttatgtacccagtagtcattcaggagcaggttgttcagtttccatgtagttaagcgattttgagtgagattcttaatcctgagttctagtttgattgacctgtggtctgagagacagtttgttataatttctgttcttttacatttgctgaggagagctttacttccaagtatgtggtcaattttggaatacgtgtggtgtggtgctgaaaaaaatgtgtattctgttgatttggggtggagagttctgtagatgtctattaggtccgcttggtgcagagctgagttcacttcctggatatccttgttaactttctgtctcgttgatctgtctaatgttgacagtagggtgttaaagtctcccattattattgtgtgggagtctaagtctctttgtaggtctctaaggacttgctttatgaatctgagtgctcctgtattgggtgcatatatatttaggatagttagctcttcttgttgaattgatccctttaccattatgtaatggccttctttgtctcttttgatctttgttggtttcaagtctgttttatcagagactgggattgcaacccctgcctttttttgttttctatttgcttggtagatcttcctccaaccctttattttgagcctatatgtgtctctgcatgtgagatgggtttcctgaatacagcacactgatgggtcttgactctttatccaatttgccagtcagtgtcttttaattggagcatttagtccatttacatgtaaagttaatattgttatgtgtgaatttgatcctgtcatcatgatgttagctggttattttgctcgttagttgatgcagtttcttcctagcctcgacagtctttacaatttggcatgtttttgcagtgactggtactggttgttcctttccatgtttagtgcttcctttaggagctcttttagggccggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgctgagagatcagctcttagtctgataggctttcctttgtgggtaacccaacctttctctctggctgcccttaacattttttccttcatttcaactttggtgaatctgacaattatgtgtcttggagttgctcttctcaaggagtatctttatggtgttctctgtatttcctgaatttgaatgttggcctgccttgctagattggggaaattctcctggataatatcctgcagagtgttttccaacttggttccattctctctgtcactttcaggcacaccaatcagatgtagatttggtcttttcacatagtcccatatttcttggaggctttgttcatttctttttattcttttttctctaaacttctcttctcacttcatttcattcatttgatcttccatcactgataccctttcttccagttgattgaatcagctactgaggcttgtgcattcgtcacgtagttctcatgctgtggttttcagctccatcaggtcctttaaggacttctctgcattggttattctagttagccattcgtctaatttttttcaaggtttttaacttctttgccatgggttcaaacttcctcctttagctctgagtcgtttgatcatctgaagccttcttctctcaactcatcaaaatcatcttccatccagctttgttctgttgctggtgaggagctacgttcctttggaggaggagaggcattctgatttttagagtttccagttcttctgctctgttttttccccatctttgtggttttatctacctttggtctttgatgatggtgacgtacagatggggttttggtgtggatgtcctttctgtttgttagttttccttctgacagtcaggaccctcaggtgaaggtctgttggagtttgctggaggtcctctccagaccctgtttgcctgggtatcagcagcggaggctgcagaacagtggatattggtgaacagcaaatgttgctgcctgatctttcctgtggaaattttgtctcagaggagtacctggccgtgtgaggtgtcagtctgccccactggtgggtgcctcccagttaggctactcgggggtcagggacccacttgaggaggcagtctgtctgttctcagatctccagctgcatgctaggggaaccactactctcttcaaagctgtcagacagtgacatttaagtgttcagaggtttctgctgccttttgtttggctatgccctgcccccagaggtggagtctacagaggcaggcaggcctccttgagctgcggtgggctccacccagtttgagcttcccggccactttgtttacctactcaagcctccgcaatggtgggcgcccctcccccagcttcactgccaccttgcagtttgatctcagactgctgtgctagcaatgagtgaggctctgtgggcataggaccctccaagcaaggcacaggatataatctcctggtgtgccgtttgctaagaccatcggaaaagtgcagtattagggtgggagtgacccgattttccaggtgccgtctgtcacccctttctttaactaggaaagggaatcccctgaacccttgtgcttcctgggtgaggcgatgcctcgccctgctttgcctcatgctcggtgcgctgcacccgctgtcctgcgtccactgtccgacactccccagtgagatgaacccggtacctcagttggaaatgcagaaatcacccatcttctgcgtcgctcacactgggagctgtagactggagctgttcctattccgccatcttggctccacaccactgatttgcatttctctaatgatcagtgatgttgagcttttcctatgcttgttggctgcatgtaggttctcttttgaaaagtgtctattcatgtcctctgcccacgttttatcggattgtttatttttttcttgtaaatttgtttacgtttcttataaaggctgaatattagacctttgtcagatgcatagtttgcaaaaattttctcccattctgtcagctgtttactctgttgataatttcttttgctgcacagaagctctttcatttacttgatcccatttgtccatttttgttgttgttgcgaattgcttttggtgtcttcatcatgaaatctttgcccatgcctatgtcctgaatagtattgcctaggctgtcttccagagtgtttttagctttaggttttacatttacattttttaatccatcttgagttgatttttgtatatcgtgtaaggaagggagccagcttcaatcttctgcatatggctagctagttatcccagcaccatttattgaatagggagtcctttccccattgcttgtttttgtcaggtttgttgaagattagatagttgtagatgtgcagtcttatttctgggttctttattctgttccattggtctatgtgtctgttcttgtaccagaaccatgctgttttggttactgtagccctgtagtatagtttgaagtccagtagcatgatgcttctagctttgttctttttgcttaggattgccttggctgtttgggctctttttggttccaactgaatttttaaaatagttttttctagttctgtgaagaatcttaatggtagtttaatgagaatagcatgaatctataagttgcgtgggtagtatagccattttcagatattgattcttcctattcatgagcatgaaatgtttttccatttgtttgtgtcatctctgatttctttgagcagtagtttgtagttctccttgtagggatctctcaccatcctagttagcttcattccaaggtactttattctttttgtggcagttgtgaatgggagtttattcctgatttggctctcagcttgactgttgttagaggataggaatgctagtgattttcgcactatcctgagactttactgaagttgtttatcagcttaagaagcttttgggctgagatgatggcattttctagatatggaatcatgccatctacaaatagggatagtttgacttcctctcttcctgtttgaatgccttttatttctttctcttgcctgattgccctggccagaacttccaatactgtgttgagtaggagtggtgagagagggcatccttgtcttgtgccagttttcaaggggaatacttccagcttttgcccattcagtatgatgttggctgtgggtttgtcatatatgggtcataatactttgaggtgtgttccttcaataactagtttattgagagtttttaacatgaatggatgttggattttaccaaaagccttttctgcatctatttgagataatcacattggctcaaaataaagggatggaggaaaatccagtaagcaaatcaaaaacagaaaaaagcaggggttgcaatcctagtttctgacaaaacagactttaaaccaacaaagaacaaaaaagacaaagatctaactgtcctaagtttacatcatcctatattttacataatggtaaagggttcaattcaagaagatctaactatcctaaatatatatacatccaacacgggagcacccaggttcataaagcaagttcttagagaccatcaaagagacttagactcccacccaataacagtgggagactttaacaccccactgacaatattagacagatcattgagacaaaaaattaacaaagatattcaggacctgagctcaggtcctgaattagatggatttgataaatatctacagaactcaaatggatctgaaagatatttacagaactctccacccccaaacaacagaatatacattcttctcattgctacatgacacttactgtaaaattgatcatattaatcagaagtaaaacactcctcagcaaatgcaaaagaactgaagtcgtaacagtctctcagaccacagcacaatcatattcaaaatcaatactaagaaattcacttaaaactatacaaattacatggaaattgaatgacctgctcctgaatgactttgggggtaaataatgaaattaagacagaaatcaagaagttctttgaaactaataagaacaaagatacaatgtaccagaatctctgagacactgctaaggcagtgttaagagagaaatttatagtactaaatgcccacgtcaaaaagttagaaaggtctcaagttaacaacctaacatcacagctagaagaactagagaatcaagaacaaacaaatcccaaagctagcaaaagacaagaaataatcaaaatcagagctgaacagaaggagatagagacatgaaaaaccattcaatggatcaacaaatccaggagctagttttttgaaaaaaaaaataaaatagatagaccactagctaggataataaagaaaaaaagtgacaagattcaaacaagtacaatcagaataaataagtgggatgttaccactggccccacagaaatacaaacaaccatcagagaatattatgaacacctctatgcacataaactagaaaacctagaagaaatggataaattcctgaacacatacactctcccaagactgaaataggaagaaattgaatccccgaacataccaataatgagttctgaagttgaggcaggaataagtagcctaccaaatgaaaaaagcccaagattagatggattcatggctgaattctacaagatatacaaagaagagctggtaccattcctattgaaactattccaaaaaatctaggaggggggactccttcctaactcgttctatgaggccagcatcatcctgatacccaaatctggcagagatatgacaaaaaagaaaacttcaggagaatatccttgatgaacatcaatgcagaaatctcaacaaaatactgaaaaactgaatccagcaatacatcaaaaagcttattgatatagtttggctgtgtctccactcaaatctcttcttgaattgtacctcacattttctccatgtgtcatgggaaagacccggtggaaggtaattgaatcatgggggcggattttcctgtgctgttctcatgatagtgaataagtctcatgagttctgatggttttataaagagcagttcccctgcacaccctctcttgtctgccaccatgtaaaacatgcctttgctcctccttcgccttctgccatgattttaaagcctccccagccatgtggaactgtgagtccattaaacttctttttctttataaattacacagtctctggtatttcttcatagcagtataaaaatgggctaatacacttatccaccatgatcaagtaggctttattcccaggatgcaaggttggttcaacatactcaatcaataaatgtgattcatcacataaacagaagtaaagacaaaaactacatgattatctcaatagatatggaatgtggttctaaatcttctcagttttttgtgtgcaatttttgcctatttatttgacttctattctttaagaaagtggaagggaagtcgatgttgttttttataagtttatcatttaatagtggtcttttttccctgttatcctattcacagtgtctgttctcacactgctaataaagacatactcaagattgagtgacttacaaaggaaagaggtttaattgacttacagttcagcatggctggggaggccttaggaaacttacaatcatggtggaaggggacacaaacatgtccttcttcacgtggcagcagcaagaggaagtgcagaaccaaggcgggaaatgccccttataaagccaggtctcatgagaactcactcactgtcacaagaacagcatgagggtaaccacacccatgattcagttacctcccacggggtccctcccacggcacatggggattgtgggaactacaattcaagatgagatttgggtggggacacagccaacccatatcacacagtgaacaagccaataactactcaatctttctgttgaagctatatttcagttttcttctcatattgttctcagtggttgtttgtccactaggcattatgtgaaatcattcaattgctataactggtaaaatgcagatggcctatactcaaggtagaaatcttggcctttaaaattctgagcccaatcatgtaatttatagagcaaagaaaacttaagcatatactcccctaaaattttcatacagaaagaggccctggaaatctcttttgaagctcagtctcataagactgcctgcctgatttgtcagataacctgtcactaagcattctagctttgaggtagcattcattcagactaggtagcttagtgtatgccaccctgaatgtacttccccattgctgcgtagagctttctgattatccacaggctaaaatgcctttaaaaaacttgactttattttttaagcagttttaggttcacagaaaaattgagaagaaggtacagagattttccaaatgcccctgcccctactgcacagcctcccccactatcgacatcccccaataaagtggtgcatttgtaacaatggtggaacctacattgacacatcattattagccagtgttcatagtttatgtaagacttactcttggggttgtacattttataggtttggacaaatgtttgatgacatggatccaccattatagcatcatgcagaagtttcactgccctgaaaaccctctgtgctcctcctattcatcccaccctcttaacctctgatctttttactgtctccaaagttttgctaaaatgccctttttatcaattagcttttggagcttttggaagattgcagctttgaaaacatcttatctttttgacttggcctgacacagacatattgtactatttaaggaaataaattggctttaaatcatttttcaattaacactagtggaaagagctatttttttcaattttgtaaattctgcatatattatttttattactaagaattgtgtttctcattaatttcttgtatgtgagaaactatatgataacaaattagtttttttgtacagaatttgttgaataggtgacagcaatcaagttaaattaataatgtaactttgacagatagataattttcatggcaggtggtatgacaatgaaaaggggatgaggaaaaattgtagcaaagggagattatatcggttggaaagagcctgttaacataagtatctgtaatgccacctgggctaattggatggtgcttctaattctaaacaattacatcaagaaactagtttttctcatgccttctctggatatcaactttaatatagttgcaaaacattatagcaataacttttatatttggaaggccaaaaataaaatattttatatttgaaaggctttttaaaagtagccaatagtctatgtatataattatatatatagtctacatatagtcatatatatagacatatatataatggtatctatagtcatatatatatatatggtcatatataaaatattttatatttgaaaggctttttaaaagtagccaatagtctatgtatatagttatatacatagtctatatatagtcatatatatagtcatatatgtaatggtatctacagtaatctcagtgaaaggcagaggaaactaccagaattgcctggctgttatcccatttctaccaatgttggcctctcaacctatgcctttaggaagatctttctgccatgacatcttcttttatagatgggaactgtgaaataaaatggaaattagatcaaaatatattatacataagaattttaaaaatcttaaattaatgcagtgaactgctaattcttaatggaatccaggccatttctttgccactaaacaagaagatgttaagcattctaaaagttcccttaccctataattaaaagagctatcaattttgtttattgcttgggggagtttttttttcactgctgtggacattctatctatgaaatcacagccttcaagtttttttaattgcatgttaacaattagctatcagagctttttaaaacatcacatttccttatagaattagtttttcattaaaaagttaattgaaatttttaaaagtagaattccttttatatcagacaggctgaatagtttgacatgaacagcctatggctttgtagtcattttatcctcattatttcctatcgtactcaaatcatttctaggtcattactaaactcacctagtacaacaagaatttcttcagtgtattccagttactggtcattgagtcccagctctaagcaatgctctgaaccaggttccctgcagagtgagtagagggatgggtgagtaaaaggagtagagggatgggtcggggagcctgacccctggggagatgcagtaagcacatgcaagaccataacccacagtggaataaaggcaaaggctatgaaagacaaagggcagacttagcccctgattgagaggactagagaaggctctgcaaggtcttacaagtgcagctacaagctaagtaatgtgaggggttcggaaatgaatttggcaattattgggtaaacgtctagttttatagacatgaccaaagagtgtttaaagtgcctcactgtggctaattatatcttatttactggtcaaaagcatcttacacatgaaaagaaaaatattatatcaacaccacaaggcaacaataattgtggaatgaaggcaggtctagaagacgctgttcccaggctttccatgagttgaccctgaagcactaggagaaaactaacttcctcacaacccttacactcttttgactggaagagtaaactgtgcacatttagttccttaggaacccacgactctacccagcagacctaaagcagtaacatacaaagacaaaacgcttgaaatgtgaacgctctggcttgggtgtcacaagatttatcccatttactgtattttccactctggatacggctttggggaggcaaacatgtcagaagtcttgtaaaaccttgctataaatattttttaaaacaaatatatgaagtttccatttattttttaggcatcttataaatattcatccatgtcttcaactatgacagggttggttttagagaaaggttcaaacgagtttatatctaaattttagtaggaattggtcagacttctatggtgcctcattttaaattaatctgtttgccaagctgtggtcacttcttgctccccgggggcaggaacttgccttataatctacacactgcaactgaactcagtaaatgaccattaattgaaactcagtaattatttacaagcccttcctattacgaggcatgaagctaagaacttttgcctagattttcttcccacagcccaaaggagagaacgatagtccaacaagcttctatgtctggctcatggggtcctataactctcgccaacatcccttatccacagacctccatactttgaaggcagcagtgtctgcctggacccccccccaccacctcccacagtaaaaaccatgaccagcccactgtaagaatagtatttgagatggttcattacataagcaacatgcatattttacattttatgtgtgtgtcctcagaccaaatacccaaatcttcccctaagaacactgtggattgcccctgttacatgacatcggtagagcaggattccccaacccccgggctacggactaatactagggacctatactgcatgcttcttatgggaatccaactaatgcctgatgatctgaggtgaaacagtttcatcccaagaccatcccatcctaccacgtccatccatctgtgaaaaaaaaaactgtcttccacgaaatctgtccctgatgccaaaaaggctggggaccgctgagccagagagagccctgttcttctcatgccaccatgttatctggtggaccaagaaatcagtaacttggcagccacttagagcctttcaattgagaagtgattaattaataataaatgttggcttgcttctcaacttggatagagcctacatgtttaaacacattttagatgagaaataacaggctttttcctcagctagccaagaggaatatatgacagatgcaaaataattggcaaccccagtccacaaatgtcccatccacttcctcaagctgggcatagacagagcaggattaaaaataagccatggaagggaatccctggcattctggttcagggacatgggggatgggatccctcaagtccatgcctggcggcaacttcgtaatgttggctgtttctgtatttccacaggtcacaaaggaactcttatgtcttctcttcaaacaaatggttagcacaattactgtagtccactcaaaattaattcacactttaggcataacaaaatctaggatgactgacacgtctgtcttaactctaaagaagatgagactggagagttcaaagtctacctgaagaaaatgaaatatttaaatattaagaaaagtgtctctgttgcttccccacagatttctccttttgccacatttggttcattaatccctaagaaactccattgtgagtttgcccttctttataccgcagtgtttatctgttgtccttgatagcgaagctttgctttgtttctttaaaaaaaaaaaaaaaaaagattcagagtctctgaaatagcaacccagctgatatatcaggcgaaatctggaaatcaaagtgatcccttctcattgaacattctctatatttggaagagagtgctacgtaataaaatatgcatgtagaaattagcaagtcagtttacacactattggattgttgtgttggaaaatctggtatccaataaaaagaaaattaatgaaatataaatatagtccatgctatcctaacttaataaaatatggagggaaatatttcaaaaggagatgatatttatcatcccttcttttcagaacaagcatttttggctgagcattaaaaaggatttaatcaactagattggctccactacactgagagaacttctggttattttcttcccattttgctctttttttcttttttctcctacctactgttaaaatggttaataatgattgagttatgcaccatccatagctaatgattctgtttacaataaatactatataatttacactgcatccctctgttggaggcatttcatgcctatggttctctctctcaagacatccaggcttgctctgtcctctagggtcaaccagtaggcatccttaccctgcttcactctaggaggcgtggccagtccagcccagcctcctctcctgttgtgagcagggctaacctctgccactgtggttcgccattagccttctcaggtgtggctcacttaccaagctctgtgtccttcagactccaagttctccgagagattccctagagctcaaagccctcttccacccataagagggaatactcacagacctctctcaacagaaaatccttattcctgccccagcctcttttggagcctggaaatggatgactggcaaaacatgagaaccagcaagtcctgcccaggtggcctcacagctcttgttaggaaagaaggcactggcatctttaggagcattctcacgctttaagatcatcgctaaaacttccagagaacaggaagagtcaactttaatatccagttacatatattccaaagaaaataaatcaactctgatggtttaaattgttcagttatcaactttctgcttgcccttctactaagaccaggaaaattgtgcctaattatggcagtcctcagaggaatacacagtggcatcaaagggtggtgacatcagtgtaactaacttacccaaataaccaataggagccactaacagcttgacgttattatttttcatcctaacctacggagaaattaaggaagtttctatgaatataccttttttacttcaattcttgattagtcttctatataaatgatgaaacaaatcttgttgcataaaaagtcatattttattgttgattttagccatgcattatgttacaggcaaaaattaaagtgtgtgttttggaggtaatcaagaacgaattttaccttgtcaacaggataagtatggagttttaactaaaagctatgttgtctacacagaaaaagatctttattttataaatatatcttaatgctttcctgatgcttaatgttcagtaagagtaattgttagaatttgcacatcattaagctttgtaaaattaatttggcaatgacatagccttggagaatcacacaatgcaagtacatacagtctcaggattgtctctttggtttatcaggaaacaggccaaattccctctgaacttctagagggactaattttcccataatactctaagacgtgactggagtgttgtagtgggaggggggtggaggtgaggtgtaaatgagtgcatacacatgcacgtgcatgctagattatagtgatgtatctagggaatccatgcaagagtctctccaaatcatctgacactgtgtacccacaaattaaagttttgacaataagtaattatctgacattatgttttgttgaggaagcatgaggttgtatgacaattaagagatatagtgaagatttaaatcccctgtttaattgcatgactggtattgtaacttatgcagcctgctgaggcatgtaaggtttattgaaaagctaacaagagtaaaagtaagtccttcttgttttggtcacttctaattgacagcataaagtgtgaggaaatagcaccagacttgggaccagaggccctgagctggagccattgttctgcagttgtctggtcttgtgacatcagtgaatcacttactttctctgaacctcagtttcctgatctataaaatggatccagctccacctacttcacatggctttttaaggaacaattctgacctatctaggtctatgtctccttgaagttccattagttttgtttcatgtaataataaatcctaaacgtttattcacctaataaccaagcttcatatctttgaataataggtgaatattaggtgaataaatgtttagaattgttatgttctcttgatgaactgaccccattatcgttatgaaatttctgtctttattactggtaatatcctttgcttttaaatctattttgtctgatattactatagccattccatatttttttgattagtgttatcataggatatcacttaagttcctttatttttaacctatttgtgtttttatatttcaagtacatttctttctttctttctttctttctttctttctttctttctttctttctttctttctttctttttttttttttttttgagacagagtctcactctgtcacccaggctggagtgcagtggcacaatcttggctcactgcaagctccgcctcctgggttcatgccattctcctgcctcagcctccagagtagctgggactacagggacccaccactacgcccggctaattttttgtgtttttagtagagacagggtttcaccacgttggctaggatggtcttaatctcctgacctcgtgatccacctgcctcggcctcccacagtgctgggattacaggcgtgagccaccgcacctggcctatttcaagtacatttcttgtaagcagcatatagtcggatattgcttttatatcaggtctgacaatctttgcctttaatatatttagatcatttatacttaaaattattattactatgtttatgtttaactctgtgtagtgctatttgctatttgagttctgctgctgttgtgctacttgttgcccttgtcagtctttctctgacttctttggggttttttttgtaattccattttatttatcttattagttcattagctttattttatgctatattttgtaatttcagcagtttccttacaattcacagcatatacttttaacatcttagtgtactttcaagcggtattacacactttgcatatagtataagaaacttacaatcatatacttccattttttcctcccaacatttgtgctattgttaaacattttacttttatttatattatatacccacattacattggtattgtttttaactatcaaccatattttaataatatttaaataagaaataccatatatatgtatctgtataattacctcctttttctacttatttgtgtacatttatgtctctgtctatctggtattattttccttctgctggaaggactttctttaacatttcttgtaatgtgggtctactggtgattaattctttcagcttcttatgtatctgaaaaaagtctttattcactttcattttgaattatatttgttgaatatagaattctaggttgatttttttctttcagtacttgaaagaaatcattccactgtcttcttaccttgattgtttttcaaatgaaattggctgccatgcttatctttgttcccctttacacaacatttactttctctggctacttttaagattttctctctagcactgaaactaaaactcttgagtagtttgattatgatgctccttggtacagtttttttttttaatattcttgtggctagaattcactgagtatcttggctctgcgggctacagttttcatcaaatttggaaatttttcaaccactatttttacaacctttttttggtcctgtctctctcccctcctttaggaactccactatgtgcatgttaggcagcctgatatttttccatagctcactaatgccctgttaacttttttattctcttttctatgtatcatttattaatatgtgttgtgaacctcaaatatctgagacaggtctcagtcaatttaggcagtttattttgccaaagtgaggatgcgtgcccatgacacagccttaggaggtcctgacagtatgtgctcaaggtggtccgagcacagcttggttttatgcattttagcgagacatgagacatcaaccaattttttaacattggttccatctgaaaaggcaggacaacttgaagcaaaggcgggacaactcaaagtggggagggggctcgtgaggagggggcttctaggtcctaggtagataagagacaaatggttacattcttttgagtttctgattagccttctaaaggaggccatcagatatgcatctatctcagtgagcagagggataactttgaatagaatgggaggcaggtttgccctaagcagttcccagcttgacttttccctttagcttagtgatttgggggccccaatatttattttccttccacacctttaagttcactaatcagtttttctgcaatatctacgctgctgctaatcaagttcaatgtattttttatttcatgcattatagtttcattttgagtttaatttaggtctttttgtatcatatctacttaaatttttgaacatatacagttataataccgctataatacaattataactactttattgcccttgtttgcataaatctaatgtctgtgccaattatgggtgaattttgattgattgatttcttcttatgaattatgttttcctggaaatttttatgacagctttattgagatgtcattcacttttaacttcaacaattcagtggctcttagtatattcacagagttatgcaacccttaccactatctaattttagaacattttcatcaccctgaaaagaaactgcacgcccattagcagtcattcccaattttccccttcccctaccctgcccctgacaaccactaatctatgttgccatcgatctgcctattctgaacattttaaatgaagagaatcacaaatgtgtggtttcttataattggctcctttcacttagcataatgttttcaagatttatccaagttatagcatttatcagtacttcattcctttctattatctcataacactctgatatggcttggctccatgtccccagccaaatctcatctttaattatatagctcccataattcccatgtgttgtgggagagacctggtgggagataattgaatcatgagggcagtttcctctgtactgttctcctcgtagtgaataagtctcctgagatataatggttttacaagggggaaccccttttgcttggcctcattctttcttgcctgccaccatgtaagacatgcctttcaccttctgccgtgatcgtgaggcctccccagccatgtggaactgtgaatccattaaacctctttttatttataaattacctagtctcgggtatgtctttatcagcagcatgaaaatggactaatacagactccatggtatcgctgtgacatattatgtttatccagtcatcaggtgacacatatttgggctatttgtttgtggaaatattttagtaggtgttaaactttgtgaacttcaccttttggagtactacatgcttcaatttctataaattctataaatattcttgacctttattcttggatgtagttaagttatttaggaataatttgttctctctaagtcttgcctttaagaataattaggaaagactggagtggtattcagcctggggctaattatttcccctttgtggtaagacccttatgcactatacccaatgctcgaggaatcttgatgttttccaacccaactggtgagaacagccactactcccatccctgtgtgagcattaggcaccgtgacctccaattctttcaggtgtctttccctggccttgggtagtttcctcacatgcatccatggatctgctcagctgaatacccaagtaggaccctcttcaatctccagagcttgtcctttgtgtgtagctctctttccagtgctcttccttgtgaactctagcttccttcaggctctcagctctgcctccttagcttggaaaggctgccaacctcccgagttgaggaggtggagctctctattttatcagaaataaaatttacactgccctacaaattgcaaaatctctgcgattgtggggttttcttcattcgtttcccatctttcagagatcactgtcatttattacctgatgtgcaatgcttttagaaccattgttttatggatggtgtgtgttcctcagttgtttcaggtgggagggtaaatctggttcttgttactccatctcagccaaatacagaagtgctgtggcctgtaatgtaaaggggtaaattatttattggtggccatcaaagctgctgcagagaaaaatgtagatggtgggtcacttaaacttaccagttacattttatattgcaaagccagccttttagaggagagtgagttgagtttttttgttatgatatttaatatgttcatgaccattccttcgggaaatccatttttgccacatgcttctttgaatgtgggaacacttatgtctctttttacaggtgatcagcgagtttgaggcctctcccgactcgttttcctacagaattcccaacctgagtaggaatcgtcagtacagcgtctgggtggtggctgttacttcagccggaagaggcaacagcagtgaaatcatcacagtcgagccactagcaaaaggtaggcagtggctataaggacctcatttcctgttgtaacttgactgtttttaagtctctattttacctgaaataaaacttacactttcctaaaaatcaaataaaccagaatatcacattttagctcaagaaacagggttgtggctaacaagctctgagcttctgtcccatggaaaagtaattccctggaggtaaacacaaagctgagaatgagtggccttacaatggaagtgtctatgaaaattaggaaaggagccctcattcattccttggagtagctgaaaatcattacacggcattttcccaaggatgttctactttcagcaaaatcaggtatcacacttcttaatgagaaatgtctattttatagtctatggaatttgcaagcttaaaaatatttgaaaatcattcactatctgttgacagaatgctataagcaaagactttaagtaacagcaggaagtaggagtcaccaaagaataaaaagttccttaaagtgaatataatatcttcacatttgtacgttaaactggtccttaaaaagcacacgcaggcacggggtattcttgctcttctggtaatcacggccatccagtgtttccaggaaccccctaaattagcattcataataagtcaatttccttacgacacaattccaggccagcaggagttgcccctaattttgagttatagaacagtggcaacttattactaatatgttctctgatagcctgaaagacaagaatgaacattccaagattccaattttacctccaagaattctctgaaaaatgtgctttttaatgagatagttaagaaataggcagaataaagcagtgaggggaaaaaagaggggtgtcacattttgagctcaaatacagatagaaaataagtaagttggtaagggaaataaactgggggacttactttatgtattacactctttggtcatgatatccagccactccctgagaatgagaaaatgatgattaccaaggaaaatgttggacataaggactgagctgtgggatttaccaaaaaaacaacaaaaacaaacaaacaaaaaaacactgcaacaaaacacataggattagcaataatgtttcttcctttcctttgtgctttcaaagttctatctctagacacagccagaaaggcctggctagtgcagtggggtatgacttactcagtgggggaacaattgaaaactctcacagaagcaggtcttgcctggggaaattcaatgtcctccagtcatttaataagtcattttgagtgcctgttgtatgtcagggtctatgctggggacacagaggatttggtcaagggaggctgactgctgaaataaatgttccctaaatctcagtggcttcacataataatatagtccaacagaggtatttttggtcagggctctcttgggtggcctgttccacatggtgattcaggcatccaggccccttccaccttatgatttacaaccctggatttctcctcatttacagctaaatagatgggggaagaagggagtatggagggtttgatgagaggttttcatgagccagatacggaagtgtatacattatttttactaatatcctattgtctagaataaaggcatggacccaccagggaaaagaaaacagggtttggagagcccagaggagtcttttgagatggtttaagagatgtgttcactccctgaccccctgaagcttacagtttggtggggagccagtcagtgatatggtttgtctgtgtccccacccaagtctcatcttggattgtagctcccataatttccaagtgtcatgggacggacccagtgggaggtaattgagtcatgggagcaggtctttcctgtgctgttctcatgacagtgagtaagtctcacgagatctgatggttttgtaaaggggagttccaccacacatgctctcttgcctgccgccatgtaatacatgccctatgctcctcattcaccttctgccataattgtgaggcctccccagccatgtggcactgtgagtccattaaacccctttcctttataaattacccagtctcaggcatgcctttattagcagcatgagaacagactaatacagtcagtaaacaaagcatcacaaaagtatatgcatagagacaaactgtagtaagtgctataaagaaatagtgtgagaggacctcacctggagtgtcagatggaggacacacttggtccctgagcacaagcaaaggcggttatgtgaagagagaagaagtgagcagtcagaagctcctgcagagaaagatttagcaggtgggaggtccaggacactggaccctgctggggccggggaaggaacagtggtcccagagacgctgggaaggaagacagggacctgatcatgctgggttttcaacactgtgttagggatttcagattttgccgcaagagaaataaggagatggtgtagggttttaagcaagggaggcacatgatctctctttctctctgtgtgcatgtgtgtgtgtgtgataaaccttattttttagaacagttttagatttacagaaaaattgtgatgatagtacagagagttgccatttacctcacacctagtttccctttttatagacatcctaattaaatgcctttcttacaactaatggcgggtgtgctttttaagaccacctggtctctctgtcctgaatggactgcagagaggcagaaatggaggagggtggagaaggagatagcaagaatgaacacccaaattctcacatgagttagcataagtggaggcacgatttcttgatgaagaagaccatggaagaagtggattttgaagccagtgagaggaggtacagacatttggaggggttcaatccaaggtgacgaagagccattcactcagaggcatctgtgcactgaggcatgtcctggctctcaagagacatctggcaggaggcagaaattcaggcgggtcagcgtctggatatcgcttacacctgggatgggaatgagattggctgagagatggaggagagatgaaggtgcaggacggactctcaaagggagtgggagcaggcaaaggaaaaggggaaaagccagagaggcagcagagccaggagggtgttaggctgtggattcaaaacagatgcttgcaaaaggagggagtggtcaggtgaggctgctgctgctggaaagtcaggcaaaaccaggcgaaaatgcccctcagtggccacacggaagatcgtggtgaccttcctgtgagcagcatcagtgggtgtggaggggcatgcagaaatgagcctgagtcaggtgagaaagtgggtaggaggtgaggggcaggctgactgggcagaacattccttcaacacacatcacctggaagaagtgacaaccaagagaagaagctgggagggggagggaggctctcattcgaggaaaggctctgggttcattatttttcatgaggcctgccatcagagcatgtttatgtggtaacgggaagatcccagtagagagggagaaacgagaaatcaacaatacataagaaagagcccacgaccacagcactgaggtttagaggaggaaatgccagtaggttcacagatttggtggctggaaatgcagggttcctggatggtgtctctgaagcattaggcaatttggggatagtggagggaagcccagaagtgtgagaagaggagggacagcaggaagccatcgttgcagggaatggggaggacatttactaaagaaacagtaagaccagcagggagtgctgacagttcaattgaggttgatgatcctaaatggtggtcaatctccaaatgctctattgcgtggattttttttccagaaatgttcaacttttcatgcttaagggaggttgactcagggttaggattgctgtaggtaggttttctggaaaggggataagctagggagtgcctcaggatggagcagacagtcagttgggcagcccccacccagaagcccagacactggcaaaccatgaaggctgaaaggcccatcctagagggatggggatgtccacagcagaggagattgagacaggttattctgtagttgttgggaagtcaaggcagaccagcagcagtctagcgacaggtagcagggtccaaaattcagatacagttgaagaagaggaggaccactgcttttatggagggagtggcagaatggggccatggcactggtcctgggggaagcccctcctaggaaggggtccaggacacgaaggcacagagagcctggccccatggctgagaacaaacgggacccgaatcagaggggacaccaggttgcagaggggttcagtttctcatcagaatcacctgggatgcttgtcaaaaggcagatgccccaagtacaggaaagagctgctgaatccacaaggctgtggtgggaacctgcattttaaacaaagattctaggggattctcttggctgccccaggtctagtgtgttgagttgcccagtcatacatttctggctagagaccctttaaatttcagccgtctaaaatgggcaaaatgggcattgagcgatagcatgggggttgttgggcttgaagatgaagtagctctagcttgtattttttaaattgctaatggaaaagcattcataagtcctggagttaatttgaggggttatgcccagaatgttaaagaacaacaatggaatagagtggaacagagtcaaatcaactagactagactaaactagggtttaaaaaagacagaaaatatcagaatgcatcacatacagtgaagtctttattcatgcaactttgtttgcacatacacaacatcccaatgcatgtgtagcttctggagtttgatgtaaaacatatttcttaaagtgggtgactgttataaagctggaaagcccctaactctagctgaatttctctagccacccgccttttactgctgaggacattctctactctctaaagaactgtctgaagtgtgtgaaaaagaaaatgccaaaagctaccaatgcaggaaatctgatgctgcctaatcaggacctttttgttatcatgatgcaaaatcagaaatgtcaatgactgatgaaatgggccctgccttagaatacttcatctcagtccagggaaattgcttgaaacatgggttttgctgcaacaaaaaacaaggtccagcttctaagccctctggcattttctttttctctctactcttgcccacagtgcccagaggcaaaaatgtatgatttggtctggtagatcctagtgactaatgtgggtattctatactaggatggctgcataatgacttggctctgggtactctgcccttccagggattctagagcttccctgggggagccttctcctcatcttcctttgccaatgcaaaccctcaacccagaaatggtgcaggggtctcacatttgtcccatttttatgggctctgaatcagttcaaggctgccttccacctatggtttccggtctgtgcatccatcgagggtgagctcctgtaggggcacctgtttcctctatgtccccagctccatgacagtgtctgaagcatactggctaaaacaaaggacaggagaagccccgggctcctgtttacaccccagaaagtaatgtcccaatgtatggcaaagactgagcagattgttttcctctggaagacttgtgtgtggtgtccctgtcagcttttgtgactcactgatggaggtagcactagaacctctcattgctggccacactggacttcaaggcaagttcaccctgggctttttctgactgtcttctgggacttctgctaccttggggctgcaccagtaccagatgcccctggcagatgctcctgtttgggcatctgaatcactgttccaagcaaatggttgttcttcaagagaggccactctgaaaatgttcattctccttaatgtgtgtcctaaagatcaacttgctataatacagtcgggaaattgttaagtagaacttgttccagttttactccttcccgtctttggggcctttgtgttttgtattgtctactttctctgatattaaagtatattttaatgagcagtttttgtgttgaggtaaattgcttcctaaagtgctttgagaaataattgggctcatagaaaacacagcttggagctgcttggcttatgaagccctagatatttaatttggactcctcatgtttagtcaatagaagaaaagaatgctacaatgggaattttctgctagttgtgtgttcttacaatgacaattcctcataacccgggtaccagagagtagtgttgacagttgtaatgtgaattggcttcacatccatttttaggtattgcccttattgagtaggtcatgttggcctctgtgtagacacgtctgtggagtaatcaggattccactttgtttggttcctcagctcctgcacgaatcctgaccttcagtgggacagtgactactccatggatgaaagacattgtcttgccttgtaaggctgttggggacccttctcctgcagtcaaatggatgaaagacaggtaaccagtaacccaatgtatgccttcagtgagactctaagagattacatctgacatactcaggttgtgtctagtggtctcctaattttgtgtttatttatattagtgaaaactcaaggaaacctaccaattcttctgagatgagggcagagaaggaatctcagctttagcactgaaagggtctgatttattgtatcaaccctctgttaattcagagccttctagttcatgagagaatgcttgcaaggaaagtagttgaaccaactcaattattgtggaagtttgctgcaccctctcaggtaaattgtccatgtaactgagatgaatgcagccaaggctattgtgagatttaacacctatctcttcttctttaaagatagtgaactaaccataactcaaataccctgagaaagaactttaagaaatggagtacattaggactttgctaatttaaaatctggttctccatactccatagtaattatttaaataataggagccaagatagagggagagagtgagtgagatatggtctgtccatataactttttaaagtgctatatctctattcaggagaagaaattaggatataagttaagggtcgaaaattcatttatgagcatagaaatgtgatctaatggattcagaagaatgcctattttcaagcaaaagcacttagaaggcataaactgtagaaataatggcttggtgtagtgaccaaactgtagaaataatggtttggtttagtgaccacttttctcatacatttaaagttggttcatccaaatgaaatatgtagctcccaaggtcaagttggcattctgcctgttgtgggaatgaccccaaaggactggacaatctgccaccggagcagtggttatgatggccacgcagttctttttatactagggtaaactcatcaccctcttgagatatcacatgtcatttttcatgtcaaaatcatgaataattgtgactttaagtgaatctaaaaatgatcccaaggtttagtttcccctgtatgatttgttcaaactggcacttctgcctacagaagaaattcccagaattgccaaaatgaggatatctccagtgcccacagagtggagtaaagagggacccatcagtctctggcacagatgaggagtccactgacttgagccagaatctgggcccttgacacagatctcatcttcaacgtaacattttttacaaaggaaaacttcagctacacagctattgattgttttcattatgtaatcatatttagttctttcataatgcaagaaatatgaagcttccaaatgtgtggtttgcttcacagagtctttctgtttttccccaacctcagctaatttggattgtaatttctttaatctgtgcatttttcttcctgtgaggcagtaacgggacacccagtctagtaacgattgatgggcggaggagcatctttagcaacggaagcttcattattcgcacggtgaaagcagaagactccggctattacagctgcattgccaataacaactggggatctgatgaaattattttaaacttacaagtacaaggtacaacatttgaggactctttttaatgatatcttttacatgtatgctttctatgcaaaaagtagcactgaacaaattttaaaatcagcccttataaagagctaacttctgtttccatattacagaaaaagaaaacacatgttcattttgcaaaatataattaaacaaatcaaagaaaatacaaagcattcacaacctcagaaatactgagatacaaaacatctttgcatacagaaagcctagtctcttttttctttatgtgtacatgtctaaaaaagtccttcttaataatttccattaattgcactgtttactctacatatatgtaagtgtatcccagaaaacacaaacaaaaaacaagtctgaattgtggtcttttttgtatgctaattaactcaatttttatatgcaatgtattttaaaaaatgaaagtaactggagctctaagtagatcgctgtagtatttagctatgtatttaatactaagtatttttcttgatatcatacacaaaatgtgcacaacttcaaaagattgtcatgttaaaattttgtgtaaatcccaatcaataagtgattgagttcagatttgtatgcacagcaatattttattagtagaaaaatcaaagtgtgtgcttctttggatttaggtgttgtcacattaatagattacagcaagtaaaaataaaatcaatactgttctcggtgggatggaaggaaaggaaaagaactatatttctaaaaatgctgcaaaattgatcttgaatttcaaattaattgaagtcaggagaattccagggaattttggaagacaggcactatattatgactctgaagagataggtcaatatattaggcttctctcagaggaaaagagaagggaattttatatgaagctttctatatgatttggataacctgattctgaatttctttagtgtttctgccctcagaacccatccagacttacttaccagtatgtattctacaagccttgtaagagagaccagttcatattctgcagttcaaaggcctgcttttgattttctgtgtgtgtgtgtgtgtgtgtgtgtgtgtgtgtgtgtgtgtgtgtgtgtgtgtgttgcatcttggagcaatagcttagaaagtgaagatttttgcaattctttttcccactagctatttttcctccttccccttttccatcctgagaagaacggaactgctaagtggatgccatttatctttttcacttaaatttcatggctgaaattcatagtaaaatgaggcatgtatccttagtaagtttaaagaagatttcaattagtgataaataactcagacagtcaaggaactggtgaggaaatgagttagatatgaatccaagtagaaatgtggctgaatttttttttaaataatagattcactccgttctatctctttagcccaggatatcaactaaatagacattttgacagaagtgaattgtatattttggcaaactgaaacacttatttaataaatggctgttaaaaatgagttggtaaatgactgttcaggaaagttaaagatgtgaaaaactaattcttgttttctaaaaactgtttcctctccagttccaccagatcagcctcggcttacagtctccaagaccacgtcttcctccatcaccctttcttggctccctggagacaacgggggcagctctatcagaggtaataagatatagattgtccacaatagttgattagttgtgtgatccacatgccaataagtgacacatcttcagcaaatgactggtatgtgttactttattctcccccaaaaatacgtcatataaacaatccctccattacctaagaaagaaaccatacatttatttttaggatatttgttgaaattcaaatcattcatccaaggatgctcatttaagagtgaaatatcaacagttgcaagaaagaaagaaaaaagaaatttggatatctcttttttgagattctaaacactgtttcttttttattttgtcaacacaaagtcattcatttatgtaaccatgggtactgtcctgacttagaaagtaataaaagacagaggacctaaagtgtagatgtaaaacaatctatttgcacaaaacctttgcaattagttcatagttgaggtgtataaacaagattttgttttgttttgttgttttgagatggagtctcactctgtcacccaggctggagtgcagtggcactatctcagctcactgcaacctccgcctgtcgagttgaagtgattcttctgcctcaacctcccaagtagctgggattagagacacacaccactgctcccagttagtttttgtatttttactagagacggggttttgccatgttggccaggctggtctcgaacttctgacctcaggtgatccgctcacctcggcctctcaaagtactgggattacaggcgtgagccaccacgcccggcctaaatgaggtttatatggaaggagtgagcatggtcgttctagtgtgggtggagttaagctagagacagaagatacacaggaaagagggcctgtaccataaaggaggtcccagggccggggagagagaataggggcttagacttcctaaggcagagaacatcctttcttctgagagagaaagaaggctgggaagtaaacaggaagtcaggagcatttcagagtgacatcagtagtgtgctggagcagctccttccagctccgagagtgaggtgccacatcccttcccagcttcatgctcagtggccacagccaccctaagaacattccctcaccatggaaatcagaaatgctacaaatcagagccttttttctcctctccaagaaccagttgttaaacatttatcagcactccaatgggtgaagggaagatcttttttttttttttttcttttaggaaagaaaaagtgaggtgatttttttaaaatcgtggtgaggatgtgtctgtggatttgaggagcatgggataggtttgtaatagctgccttgtggaatgcacagagagtcattaatagatgaaccgagtcattgccaagaagcttgcaaggacccagctgcagatgcacagcacaaattgtacgagtcacaattatcactgtctaatgactttcttttttgttttgttttgttgagacggagtctcactctgtcgcccaggccggagtgcagtggcacgatctcggctcactgcaacctctgcctcccgggttcaagtgattctcctgcctcagcctcccacgtagctgggactacaggcacgtgtcaccacgtccgactgattttttgtacttttagtagagatggggtttcaccatgttagccaggatggtctcaatctcctgacttagtgatctacccgccttggcttcccaacgtgctgggattacagtcctgagccaccacacctggcctaatgacttttctaaatgattctggacagctgggaagaaaagtggatcacagattaccagtaacataagcattgccagaagtctgaagagtgagagaaactaggctccttgttgaaatggcctaccaaaggttccaggctgactagagaaccttcttataggaaaaaaatagggggcacctagggatgggctcgagggaccctaggttttaggctcaaatgaaatgaggcttggattctacaagtgtgagagcatgggagaggtagaacaagaagggtgtgtcagagcacaaggtcttccagatgaagccagttttagtgagggagagtttccaagacaaaggtaacccagcattcctgaaacacagtagtggccaaagccattgccatcatcaggaggtgtcgtaagttgtgtgcccacactgatggacactgatggcactgaggatgatagcaggggacagggaactatacaggcctatcaccaaggattagaggagttttttgaggtggcttcgagggtggaaagtgggaggaaagcagagtccctacaatgtgtagggcggctggaatacaggctgggatgtggctgggagcaggtgcacaggtatcacctgtcaggtactgaaggagctttatggaggtcagatgaggaacacaaaggctcaggaaggaggagggaccctatggccacagaaggccagtggtgagggaaggctgaaaggagtaggggagatactgacaatgacctcagaaggaggcatcagagatgagtgatcgccatgtaaggggtgtggaaatcagcaaacctgcccatttgggtttaggagacactgtagtgtgcagggaaaaaaaatgctttatttttattaaaatggagctccacaggacaggaatagaaggtaccaacccgttgttgcaaacacaccatgttccaggccagctagccagggtggagaaggaacatggctgcagataacagggctgaaggagttaacaggaagaatatttcagcattcacaggggtgaagaacatgggcttcaggctgactgcaggatctgcatcctcctttcagcacttgggactcaccgcttaactgctctggacttcagtgtcccacgtgttctgtgggagagtcgtcactgttccatagggttgcagaaatactgtaagcaaagggcttaggacagggcttggcatggagtgagtgctctagagtggacagtcatccttactagttgtaaaagtagaggtagtgctcatgtgggggaatgaattgttggaggaatttttcaaaccaaagagaagccaggttactgtcagaatagtgggatggctgcaagacttggagctgtttctcctagtgtctgtgaactgtgagaccaggagtacatgaggagtgaggcagttgaagaaatctctactcccattgataatgtatccctttcccagagattcgagtgtcttgcaaaaataacagcttcagcctatgtcttcactcaaggattcaggcatgtatgatctgagggacagatatttggcaacttaagtattccctgctgctcaatatggcttttagaagagaatgagcagaaaacagcaatacttcacagtgataatgtctggtgtggcccaaatgactcactaatcaatacatcatggtgcttctcccaggctgggttacatttcctggaatcagaaagagcgaaaatgttccttctgaagattcttcagttctgagaatgctcgttctattacccacacaaaatgcaagcatcagtccacttcccatagaaagcaaacacagtgctcatgtgaatctttctcattctctgcaggatacatactgcagtactccgaggacaatagtgagcagtgggggagttttccaatcagccccagcgaacgttcctatcgcttggaaaatctcaaatgtgggacttggtataagttcacactgacagcccaaaatggagtgggcccagggcgcataagtgaaatcatagaagcaaagaccttaggaaaaggtaggtatgccttctcatcgcttcttaatatcctttcttttcccggccagaagaggagattggaatcataaaagatccatcatgttttacgtttatgtgtttgaactttgtcattcctcacatggcttcagcagtgccacggcataatgagagggacagctggaccttccagagtgttctggtcctctcttttattgtttcatttgcagttaaaaagaagaatgtcagtttgaaaatcaagggcgttggtgtgaatgtgaggtgccaaggctgggcagccatgaagcgtggcgcttgccctctcagccgtttggaggcgcccttctcccttagccacccttgctcccaccttcctatcatttccacattgccacatagccaccgcttttcagagggaaaatgatggggtaaattgcgtttgttttttttttaatctaaaatgtggactttcaaggagatgaatcccaaagaaatcatattcagagaaagaggttttgtcccaggaactccagaaggaaggagggatgatgcagctctatgtgggcataggaagaaggtgaggagatgtctttgcaggcttccctcccataggagtcctaccaggtggggtggggtcagatggcaggagagcgagtaatgagatagcaagggtattatttgtgcctggtgccacagttttgggtaacaagtggtaagaggtcaaatgatcggggattgatttatgcagaaatatatcctttaggtccctgggcaccaagaccaagtgtttagttgtggaggaaaatctgttggtgcttcccaaatccaactctgtcttctcttgaatcaggttcatcacatgaggatggaaaaagtgcccagcacactgccccgcaaaccacagaaggaaacccatatgtgaacatcctattgttctttagggaactctaagataccccaaaataacctccacccatgcaattttctgtcacacacccaggtcattacagttggagaaagcctgttggtccataaagtctctattaacaggggacaagttgccagtggcctgtgagccagacttggactgagctcctggcctcgctggaggaagcagtccgagggaaatgcgtgaagatgctgatggcctccccatgtgtcctgtgagctgacctccatgtgccttctcccccagagccccagttctcaaaggagcaggagctgtttgccagcatcaacaccacacgcgtgaggctgaacctcattggctggaatgatggcggctgccccatcacctccttcacactagagtacaggccctttgggaccacagtttggaccacagctcagaggacctctctctccaagtcctacatcctgtatgacctgcaggaagccacctggtatgagctgcagatgcgggtgtgcaacagtgcgggctgcgcggagaagcaggccaacttcgctacgctgaactacgatggcagtaagctggctggctttgtggctctcctgcttgtgtcttgggggatgtgcacgtgggccctgcccctttcccatcgaacatcatctttgccatagtttgaccagtgcccacggagcccattaggctttcgggattcaatggactctgtctggggctccctagttcgttatatccagatgaccatcactgtgtgtccagaaataagagactcagggccatagggagtctcactggggagtcatggggcaggagtgatttctcttagggctgaaggactcttgaccctgtggttctgtgcttgtgttgatgtctatgagctaacattgcttttgttgtctcccacccctttccccacctcatcccaatccacataacaactttcttttttgcactcattacaccctaaactgcatgtgcaaaaacaattttccatggtaaaggagcttatgttagtctctgggcaggagcagggccactgatggaaataggataataataggaatccatgaacacgtgcacacacacaaactcacacacacttgccacttgcatttactttccaaaaactaggtgaggtgtctcttgacattagttaaccaaaaataaatggtttaaaatctcactcattttttctggtatcaagggccatttattgctaactgaacaaatgctaagcccagtgaagctgaaaggagcgagtcctcgactgcaacttagtaggggaactttagaaagtcccagcagcagcgggctgatgctcatttctcactaggggaacagcaaggattgagttaggtgctctaattgcaaggtaaaaacggcagcaatgcatcaggatgagttggaactccagtgcaactctcctcagagccttctattcactgcctgttggtcaggctagaccacagtgttgaatgagttaaccaagaaacacccaaaccctttattgacagccaagccaagaccacgttggaagtgctcctctacctgtgggtgatgctttgtgaggggatgcctttcaatgaagtcactcataactgagggctgtaaaattagacagaggcagcccatgaaaagcatcagcattgctctctaggagagtgattctttctttactttgtgcatttgggaggccgctttattaaagctccagcaggtagctccttggagcacagtttatgccatcctaagaagagtggctgtgaacctaaggacccacagaaatgaccaccaggagctaatgaggtgacattgcctgggattttcatcggaccaatttctcctataatgtccggatggcccagggctggctcttcttgctttggcacacagagcagacctaccccaaatctcctgtccaaggtcatttttccacaacatccttctctgccagagtccagggtcttcctggcacttctggcctgggtctcagggctgtaggaagaccttgagcttgtagaaagctcttctagtgttggttacgctagccggggtccctggcctctgcacgggctctgtcctatggccccagaatagcctatgccctcccagacgacaacttttctcttcaagggctgatgcttttcatgggctgcctctttctaattttatagccctcactcttcagtgacttcattcaaaggtgtccccatcacaaagcatcacccagaggcagaggagcacttccaagctggcctctccctgtaatatggttgaattatttgatcttacaaaataaagaactttgacacttaccagacactttacttagcatttaagggtgcaccaaaatcctctgttaaccagcacacatttgagtagtaagtatcttttttactttagatcattatcttgcaatattcacactctggttcccagcttctctataatatgtgcagatgcctgggcacccagcttaaatgtgcacactgatgatatgctcacagctaatgatttaattagaaactactcatgtgtagaatttgaaactgtgattctaattcacaaagtgttctgcggattttaaatgtttgtcttctaagaaaagatataattttctcactttatccaagatcccaaattttgaaaaatgctgcaagctacctttacgttttggaaatatgaaatcactttattacactaagaaatatggctgcatatttatattttccttgagagagattacagatttctttggaccagtctcatgaatggatagcctctattgtcacatctgcctgaagaactttgttatcttgagaaagccaagattggcagcctacattcataccactcaggtttcagagtcctccatttaatgatctcactctttcttctgccatttccttagccgaatgtttctgcttgacctagtgttgtcttggttttgcagacccctcttcatgggcatcctgtaagtgcctctttcctgaatttctaagcatttggagacttgggcttccacaaaaacactttaaagttgggagaacactcttctcagctttagcagagatcacagaggaacgaggattccattatccctgctctgcttactaaatgcaggataaagaccgttttgctgagggagaaattatattatttttgcattctcttttcctgaagtgctgactttctggcccttgttgtacatggaaagtgcagtggcgtggagcatcttatataatggagggtagcaaaatatatacctcataaaaagtggatgcctgtgtttagatctctgcacccacggtactgagcatctggatagaaggcagcttaagatagctcagagttcatcttccttcagtgtttccttattactcgaaataatctagattttgtagcactatttaaccatgcctgatcaaaagtaggctcctttagaaacctagttgggtcccctttgaaaagctgtctgtagctcttgtaccctcaaaccacagctgttgaagtagatttggtcttacacctgcgataaaagccagcaaattacctaatcacaagggatttgagtttctttatgccagtgtatctaggaccctctccctgcacacgcgcttctgtccatttgcccaaccttttgttcattctttgatgtgcaattttttcgaatagtctctatcaattgtactgtgggtgacagtcaagggaacacttaattctgggtagatgcatgtggcttttgtcagcaccaagcctgggcctcatgctttcaagtgcctgcacactgtagtgcattgcaaaatgaagtccttttcaaacgtgcactatagaataagttggaagttcaggcagagggagggaaataaataagaaaaaaagttagccagggcctagagacagagttcttttcatttctcatcacctccaacacccttggatcacacagcgcgatttttataacctgtcatccctaaaagctccgccatgccgtcttcattaatagccatctaacaccgtggccctgctttcaggtacaattcctccactcattaagtcagttgtccaaaacgaagaagggctgacgaccaacgaggggctcaagatgctggtgaccatctcctgtatcctggtgggggtcttgctgctgtttgtgctcctgctggttgtgcggaggaggcggcgggagcagaggctaaagaggctgcgaggtaggtccaggcccagctgtccacctacgcgtgtcccctgctgctctgcagccaatgggagagatgccagctggagaacaaacctcaaaagggagtgactcttccctctttaacccaggtccctccactgcctggttctctgacattccttcagcgagactgcagagcctcagggaagagcaataagaatgttcctatctcggtcagaaatcaggtgaaagccaacctgtcccctaaatcctagctgttggtatgcaaggaaaattaattttttaactctagtctcttaaattttcagtgggtccagcaaagccaccaattgtggctttctatgaaaagatctatcagatttgctctgggaatgagaattacttgactgactggaagtggaaattgagggcttaggatactggtgaagcattgtgaggcagaggacacatgccatcccaaattagaaacgggagctgaagcccagtgtaagagtttcactctaatgtagcaaaaacataatgaaggctggagaagccaggccagatgagctccattgtgaacagacaccatgattataatgtccagccccgtgtcgttctgtgatgaggctgttctcagcttctggccaagagcccttacttgcccttgctctgcaatgtgaggacagggagttatttcaaatatgaaactgtgcagacgtgttcccaggtcctttgccctttaccagtgagggtgtttaactaagccactttttcggtaacgtgtattacaagggattttcattttaatatcagtgcagtgtgggatactgctatgcagcatcctatgtgtgtttcaaagttatgttcaaagtacaaatctggaagcactctctcctcaaaacatatcccaaactttactgatacatttagaaaacgttgacctcttctgtaaatacttaatttgaccataatccacttagagcagagaacatggtaatattttcacctgtcttcacttatccaaagcaccaaagcactgctttttatggaattctggtacatttcactatcaacttgcttttgctctgccaacaaattacaattctgaagtacattgtacttcatctgtacaattaagaatctgtccatgtaaatctcctgcagcccaataattcaggtcagccatcagtctccttgaaatgttctttcgcaatcgtgcgaaccaattatcttttaattttgcagacattacttgagtgaatgctaggtgcttaatacacaaagatgagaagaaagagctttctgaactctaggtttaaggtaggaggtaggcccataagcagctaccagtgaaagacaaaacatgtcatgaatacagaaatagggcttcaaagaaagaccgcatcagtgaaaaagaaggacggattaatcccaagtggagaggaaaagggaggctacttcagtgctaagtaaaacagaactacaagcgtataatacagcccattatggtgagaagttccatataatgtggaccatgttgaattccattcagttcatcactaaaacacaaaaaggatgttttcataacccttgttcacagtggcctggactttaggagaattattatgagataccaagggtgtctttccttgttaccattagacaactatgtctaactacttgcatttagaaggctgcacattgtctgtatgatgtttctaaaaaccaatagtaaatatttcttattaatgattttgatttaatcacaagagttaagcatctaggtaatgcttctcatcggtctacaccctcgccaaattcactttttcttcttttccctgactcctattgctctccatccttctcagctactattttatttttcctactcaccttcgaacttgagcaccccagctgtgcatttcctctcgctgagagcacctccagttaaaggtgctgtgggctcttactgagtgaggcctttgggttgaaatgatgacccatgcaccctgtatttgtattcttagtagttccttgtaatttaattgttgctgtacaagggctatctccagaaaacatcctggggctggcatttttattgttggcctccctgcttccagacactagtgttttgcagttggttttggtaaagacagcagtctatcacctcagagaacatggcctttcattctccggaaatagttttgatttctatgttctggggaaaaggtaaatccaacacaaaggtttcagtaggaagaaagtaagtgctgagggaaagagggagtattactaagagatgttaaggagcaaaggatttcagaaaagtagcttgccatggcacaaaggtatctgcagttcggcattttgtacatggctaataaagggttctctcaaatcaagaatctgacaggagaggccgggtgcggtggctcacacctgtaatcctagcactttgggaggccaaggtgggcggatcacgaggtcaggagatcgagaccatcctggctaacatggtgaaaccccgtctctactaaaaatacaaaaaaaattagccgggggtggtggcgggcgcctgtagtcccaactacttgggaggctgaggcaggagaatcgcttgaacctgggaggcggagcttgcagtgagccgagatcccgccactgcactccagcctgggtgacagagcgagactctgtctcaaaaaaaaaaaaaagaatctgacaggagggcggtcaggatgccaaggattgggtacccaatttcacaccacttctgaatggcaagttttaatgtagacacactgcaataaattcagtttgacaaaccactgtagattatctaccaggtgcaagatggaacctttttttaaactagtggtaacatttgctggttgaccatttctatttgatcacaagagtttagccaggtcctagagagagaagagatttctaagactcagaactataaaggtgacattgtagtggcagtgggtcaaggcttgcaaggggcagactcatctccgtaactgtgcaaagcactgccataaaaggacagcgccagaggtgagggtggtaaaggggaatcgatgaaaggtcaggcattgccccagaaagacgtttgtttcttagccctgcagggccctgaaatgttcattaatgatacaaagtattttcaactcactcatggagggaaattgcagctgcagagtttaaaggaataggtgcctgtctattaaatatccggagtgcattagtcgaatcacccaataacaagcgaacccacataaggtacagactctgtgcctctgggagaataagttcaaatatatttacagactctacagacagaatattttgattgtcaaaattaaggacaacatttctagtaacatgtcagtgttgcgtgagcaaccatctatcaggatcaaaaatggaaataaggagatttgaattatagaaaaatattatagggatccccagtggatgtttttagagtgattaggtgggatcaattttatatggttgaaattgatcacatttttcaattgctagaaacagcaaaaatgtttataagctgagtatgttttactgtatagacaagtaacctagttagatgaatataatataatgttattttatgtaaaattttagaaagaaagaaagaaaatgggactctagcagtgtcgtcaacctatattctctcttcctgagtactttactaattttagagcatggcgacctcctaaactctaaattgcctgcaagtgcccacatttttttttaaatctataaccttatccaggagttcaggagccgcattttgcttttaatgatgccctggtttttcttgaacttctagatcctttgaagtgcaaggttatagagtgagtcactggttgggcctgagatcccagcagccctaaccttataaaatgtgatcccgtgtcaagtaatcaactccaatatttctaaaagcctcctcctttggtacgcatttacgcaagaaggcacaagcttctgttggcaccagttagtgtgggtcaacctgcaggacttcaaataagctaaagataaaaatcagtgagtgatgtcacatttgaccatgcttttgtggcagagtgtcttgcttctcttgaatggaaatgtgtttattattttaaacatgctttgaaatggattgttacaaaactgatcaattccggaagagactgttcccagagaggatctgggttcatggtgctatgcaggcagattaaggggtaggttatgagaaatcattgttattttctgagtactaacaggacatttatctgctctgcaaatgagcccaaagctcccctcatttggaaaaccaaaaggtaacttgaactttactaacctaaagcaggaatgtgcatccaggaacccagtgacactcagacttgagatagactcaaagtttcaatagatgccccagcactaatgcataaagccaccctgaatgtgggaagcccacattgttaatgcatgagtagcacacatgcaccctagagctttcgttaccaagtgtggctaagatggcattagaagcctgtactctgaaactctttagttctgtgctttgtgttttctttctttctttctctttgtctttctttctctttctttttcttttcttttcttttcttttccttccttccttgcttttctctccttccctccctccttccctccctccctccttccctaccttccttctttccttctatccttccttccttctctctccttccctccctccctccctccttcactccctccctccctccctccttccctaccttccttccttcctttccccttctctctccttttttctctctctccctctctctttctcttcctctctctttctttctgtcttggtttcttaatgaaattattctcttaaaacatcaaacttgttatggcaaactgaatagaaaaggctctctgcatctgacagcgggaagcaaaagagcatgggggtgagggggagtcgagggctaccagtggaggggagccagggagtgggtagtcaggaggggattgtgggtctcagccgggccctggagctctgccttgcctgggtgtcctattttgtctgtgtctgtgcatgcagttttttcagattaccagtatatatggccttctttttttaatatatgtctgccacagttttcaaattagctttcatctgagcattgtgatgattggaagtcctatttgggatcttataaaaacataaatgcaggtttatagcccttgcaaaaatagctactttatgagactatttcaattccacagaaaggcagggactgttgagggagaggctgcaaataaaaccttttgatggatggtaatataaggtcaaaatctgccaccctcagaaagtttttttgtggatatctgcaagtgactgcccagtagaagtattaacctaagcgtcttccattttacgtaactagaacttcagatatgaaaatgtagccatgtggctataaacaagatttctcttttttaaagaagcatttgagtgtgcaaaatgtgaggcagttcagcctctcaagctttgcacagctgcagtgcctggggccatggtgggcactctcccacgccatgctgtgtcatgctctgccttgctgatgtgcaccttcatgccaggcacaaccccaggatgcaagctgtggtctataaacagaacacaggaactgggcaagaccaagctgggagcctcctcatccaaccagaggtgccatttcccaaaactcgatctaaccatgtactaatccacaggctactaatgcttcccattgtttcgctcctctttcttctccatagtacttcactatacaccatcctgccttagtctctcaatagccatgcaaaatggttgagtatgaactgcccattatgatgccccaattttctttcttttctttttcttttttttttttttctgagacagagttttgctctttttgcccaggctggagtgcaatggtatgatctcagctcaccacaacctccacctcctgggttcaagcgactctcctgcctcagcctcccaagtagctgggattgtgggcatgcaccaccatgcccggctaattttgtatttttagtagagacggggtttctccaagttggtcaggctggtctcgaactcacaacctcaggtgatccgcctgcctcagcctcccaaagtgctgggattataggcatgagccactgcgtccagccatcataccccattttctgacgtgaaaactgaaggccagctatagaattatccagaatcacatatgagtccaggcagagctagaagagagttcagatcaatctccctaccctactcctcttgccatgaaacttctgcaggattttgaatattcaagtaagaaacaggttgtctcatcaatattaagtaagctctaaaggtttatcaattatacctggaattagaagatgtattaacacagtatcaatagctactatataattttatgtttgcccatcaaaaatacttggtctattgattttgtatttcgatattcactacccttcagccttcccctaattatattttaaatatgtatatattatatacagagagaggcacatatacatattccttctagcttgcatatcttcatcctactgtctctctgattcttttctccactgaatacttgagagtattctgtcctcagctacactacctctcaattactcccaaattcccacagtccccttccactcgccacccaaatgtaactgttctcctgaagacagatgaccagttattctctgatctccaaattatcctttcagccatcattttttagccctctttgcagcattcagagtgttagcaaatgttgtcttttgaaattccttccttccacattttaatatcactagattatcctggtatcatttctccatcatttcccagcccaacagataagggaggagcccagagccaaggatggaagtgtgggagtagcaagcggctttagaaaagatgtcgcgaagtctgaatctcaggctgatctgaaatgtgtgggaaaaaatgtgacaggcaatgcaagggctgtttagctgtgtttgggcaagaagaacaaggctgtgaacaatgttctcatattaacagatggcaggtagacaggagagctgctcagcatctgctttgcttgatgtgtaccaggagaaatgctatttgaatcagaaaacgtggaccaggaattataaaaagaaggaaggaaggaagggagggagggagggagggagggagggagggaatgaggggagggagggaatgaggggaggggaggggaggggaagggagaaactcaggatgcttatgaaaataatcagcaccctgatagtttaaaaggatttattttttttcaaaacatactctgtattagccattatgtggaggtggagatgttgctttttgcagacaatgtttacaaagaactattacacaagttccaaagcgtaagcagcctaatgcagacagaataaatgctgtgctgtttcactgaaaggaaagatctccaccacttaaaaaattagggaagctgtcatggggttccagtcccatgattctgaaggataacattttagggttctgaacaaaatttttccagacataaccccaagatctttctggataacctttgaacaatcaaatgtaaattagaggtgttagaaaatgattatgcagatggtccctgacttactatggttcaacttaggagtttttgactttgcaatggtgcaaaaatgatatgcattcagtagaaactgtattttgaattttgatctttgtctgggttagtgatatgtgatccattatttttacatgagatactcaacaccttattataaaataagctctgtgttagatagttttgcccaactgtagggtagggtaaatgttctgagcacgttgaagataggctaggctaagccctgatgtttggtaggtcaggcatattaaatgcatttttgacttaattatattttcaattgatgatgggttcatcaggaggtaatcgtaagtcaaagagcatctagaccctggacccattttcaacaacaatagattaattctggacattatagactgaaataagttagttgaggttatagaaaggatgttttgtgagcaatcagggaagggaagggaccaccaggggcccagacaaactccatttgcattttgacagggctgattaataagggtacaccaggatgtagctgaaagcatgggcaggctaatccaatcttggaggccacatacatcctggtggggaagctaatgtattagagggacaaatccacattttaagagattttgaaaggctggaagcaagaagatacagtttaataggaataattgtgaagtcttctatagaagttgtaaaaaaaaattcatttgcaacacgtataatgagcattgtgctctccctagtgtgctagaagatcaagaattaccagcgtctttctcagcctcattttatagagaaataaaaaaatcacaaacctttcaaagaagagattcccaagtagggaattacctagaaatcattccgtatgaggagtggctgagaaaattagagaatgtaacccagaaaagagaaagctgaggccaagcaagggaaatgcagctacatggaaatatctgaacagctggcaaatgacttcaggttaaaattacatcaaggaatttctgcacaagaaaaggaagatgtctctcacaattaaatgtgtcctcaggaaatctttgtgcagcttcactatggatcagggacaggactgtgcccaaaagggccaagagaaagacaacccgaaaacaggtgggcacagtatgagctgggaagggctgtctgagatataaggcagaggtccagggaagcggagggaaccgaagcttcacccctgcctactgggcatgggagggtacacggagcaagttgcgtctgcatggggcggtggggacgatggagggctttgcactagcaaagtcttgggctctctgcagaaagtggcaagtgcaggaaactcagagagaggttggaggttacaagtgagcggcagcggagccggatgacagcttggaccagcacggaaggtgggttctctgtgctaatgagggctgttgcagtgaggtccctttgaaggtttcaaagcacaggtatcactcagtaagatggattccagtcttcacccttcctgcagtgtgggtatcagtgttgggcacaccagcagtaaggatgctgactaataagtgagattaggactgagaagagaaaaaacaaaggttcccctggggacatgctggctgggagagacctgcagacctggaaggcaggagagtactgggaggagaggaaggacactaggtgtgcagcaggagcaccgaccccaaccgtggagtggcagtggccccagctctggattcatgcagacagagaatatgtgtacgtctgtgtaagacattgtgaaagggattccaacattcattaggtggccaatctgaaaagtctttattgctcttaagattctgtgattccgggactttaaatttttttcttggcttgtctcagactctcttctcaccctcaacaaaagtgtgtcccagatgagattttgccatcttctttttgcactctctctatggggatatgaaaaacacccagaccctcatctcagccctggcatctttccaaatttgattccaaatttgcctctgaacagcctcacctaatgtcccccgatattgaaactagacaagtctctcccaagattgctgcttccatgttgttctagtccattcctgtcactcatgttactacatccagctctgcatatcccaaatcttgcccttttcctggactccctgcaactcctccttgtcccactgtacacctggtaggactctgattcgtacagatttcctctatcttcacattataatgttacccacataaccctggctctcttctctaatgcccagagcctctcacttggactaaggactaagaagctttcaacaagtcccaggcccccacctccacattcagagcattctggattgcctggtggatgctagttcacagcacccacacccatccaccacccacctctgccctcctttttcctctctccctttggcccaggtagaagctttcaggtcagtaatacaaagtcacatctccttagctctttaatgtctagactgtgcaccagaccaccatcctggcaacttctctgtccagtcaaattgacctagactttacttctcaaatgggctcataattccgatgcatgtgaattctctgcatggagcacactgcccattcatggcaaagctccccacgtcccatgctcctttaaggtggggtcagtgttaggtttagggaagggttgacccaaacggtcaacccttggcatctagacctgtgaaagaccttagccttggggaggatgcctgcacgtggcagccaagagaggtctgctgtcggcatggcagtcattgtggggagctcttttctccctgctggactccgcaattccttagtacattgccatgaacagctcataggagagagctgtgatgactgaccgagaataggaaaaggagagattattgtggcgggcagaatgaggaaagcagttgatcagaagacaattgaggctgagaactctttcaagtgtgaactgaagtgggatgtttactccttgaatttgtttccccctttttagagtattgtaccagccactgcttggtagttcattggagctaattaagtccaggcttctggcattatatgtatgtgtatatatatgtgtgtgtgtgtatgtatatatatatacatacatgaagtatatataagcacatatatatatatatatactttgtaagtgttaaatcattcagggaaagaggaaattcattatatttactgtgtctttgcagataaatataaagacatgaactgggaaatccaatcctattttgatttcttttctttgctgtgtgggtggagtatatgggccctgtttcattgcccaggctgaacccatctgtgcacaaaaccaggccccatcttggggttaccattgggactggccaacttaacgaactaagcttggctcatggcaaggacagcctctacgtggtcattctgtgactgtccacgtctttcagaaatagcatgctgcccactgtgcagaaactgactacgtttaattgtcagcccccaaaggcatgagatggaaatgctcccacatacgtatactttcactgcagagctggtcacactgtcagctgagtccatttccggaaagttctgttcattgaacagtatacttagcatcaagactttttagagagcaatgaaataaaaacaaaaagaaggtttttgtgctctaagtaaggaaacattcatttttgccaggaccaaatgtgtaaaaagaataaattatattttaaaggaaacgggaatttcaaaataacaccaccaaaaaaagggattttttttttcctacacttttagtcaggattccttctgtcaagagtggtaacccggtcttggtaaacaatgtgctcagagaaaaaaaaaataaagtttttttaatttctgaattcaaaataaacatctaagtttccaggaacatttatatttcatttatacgattctttggtcaacccaaggaactcagagctctgtaataatgccacttacttctgatattttgataacaaaaagcatgggtttgttcaacgtaaatgatataccctcaaaatgttaattttctgactactgaaaataaaattggatttcctagaagtgactgtaggttggaataaaacatttagtagatgtctgagaatgttataatcataggatagttatgttgatatttttgtaattaataaaatacattttaaaagtcccatttagaagaaataaggactccatgaaactctaggtcattagtagtgagctgggtatatgattgtgtttcaaaatgactgttctgatctgactgtagagtatttgtcataaatgcctaagtgaatgttaatgagttatttaccatgtactaatgttaactttctttccccagatgcaaagagtttagctgaaatgctcatgaggtaagaacaagacctagcaccccagatatcatgtttgaaagaacaatttccaacttgccttgatgatttctatttttttaataatggcagtctgaaattgataatgtcttttctttttagaaaaaactgtaatttcctatacattccaaaatatccatgtaatgcctagctgaaggtgtagatgaaaatgatgtatttgtagacatgccacaggtagttgtcttgttggctggacacaaccaatagaaggcttcccattagcctgggaacagaagcacgtaaagaggaagtagctttagttttgccttcatctaaatttactactggtgaggtcaagccttctttctaacagaataatccaagttaaaagaaaagcacaaaaggaatgtgctatgccccatgctcttcaaaggctctgtgtctccatcagcaccctccaccagggcacccttcagctcctcttaccactgtctgttcactgtctattctggtcctggaagtcacagccttcatagttcatcctcgtgttaggagtagccagcacagtagttgccccattcataaccgtggaggggatgaatgaagagtggttattgaatgagtacgagaatgttcacaactgtggaagacagaaatgcatccttcacagctttcctttcacacgtccacaggcttgtgattggcaaagctgtgacaagtgtgttactttcacgtccccaaactctattttccacccagtccccctcttcaaatgttcagttttcttgtgctgtccaacctttttactctgtaaatactagaacactctgatatgaagcatttacacgtatggattaattgcctgatgtgttacctcaccctgatatttgcattttaggcctttcatattgcaatgattacatgaaaagtgaaaaaggaaaatcagagtctaggaaataagtagggaaaatgtcaaggactccgatagtgaactcaacattgccagtttaggatgatttacgtgggagagagagggtggatctaggacctcttcccactcccatcaccaacacatttgcctgtgacttcctcctccatctatacatataaaattagtactctttgttatttaaaaacttcccatgttccatatcactaatatctttgaagaccgaaggcagtagtagaatgccattggcacacagattccatcctacagacattttgtttggccataccgtatttcaaaacaatgtgaatcgtaggtaaaacaatgatatgaaggataagtcttttcctttttcttttttttttttttttgggacagagttttgctcttgtcgcccaggctggagtgcaatggtgcggtcttggctcactgcaacctccgcctcagaggttcaagcgattttcctgcctcagcctcccgaggagccacgattacaggcgcccgccaccatgcctggctgatttttgtatttttagtagagacagagtttcaccatgttggccaggctggtctcgaactcctgacctgaggcaattctcccgcctcagcctcccaaaatgctgggattacaggcatgagccaccacggaaggataactctaaaatacatttgttgtgactgatctgatgaatgttggtgccatctgccaagattaggaagatagaggcaggctatggacttttgatttttttggaaggtaggttgggaggaggtattgatgggaatgaaaagacctatttgggtcatgttgaatttgggattatttttaaggcatccagaggaaatgtcagatagacaactggtagcagaaatctggagctcagaggaaaagcaaagatgcaaattccctgtacagtatctccttcataaggggtacttcatcacatttccaggagaagattacagaaattgcatgagatgccttcagcccgtgctttttgtttatgtgacatttatgggtcacagggaacacatccaaacacacatgcacttgtgttaagcagatctgataaaacaaagatctgcttaacacaaagaagctggaaaacaaagaagtcagagtcacatgacttgtaataactgatctacctaataaaagaaattgtcaaaggtagactttaaaaatatgaattagttgatgacatttaaaatgaggagatttcacataaaatttggctttctgatttctcttgaaaatgccctggccatactagcaccgcggaggtgataatggtgcctggaggtaggcacagtagccctttagaatggcgtgagtttgctcaccaccgcagcccccacccctaccccaccccgggcctgcttcaccagtccgtacactgagcagggctccttcagccctccagagagcttctcctcccctcaactgtgctctgcacaacctaccctggccccctcccctatctactcccaaactgtaaatcatgcctttgtccagaggctgtgaaactgcgggctatattttctgacatgttcaacatttgctcaattaggatgatttgctttttctcttctcctcatattctagagtacattcctactccttctccctagcctctgagaaagacattagcaagcatcctctatgaatagggcagttgctgtggttgcaagaccatctgttgataagaggaggaattaattatggtcttcctattgccagttaccagcatgaattaggaagagtaaagccagtaatcacaaccacttatgatagttacagtggttttccttcaaatggtcaaagtgattgaaaaggaagagaattttcaagctcctccaataggtggatttgtatgggattaatttagaagtaaaagcaaagcttttacccatgaaaggttggttcaatctaagttcggcaggtgaatgggccaagcaaacaaaaacctcattacctaactggtcaatttagaatcaaccatatttggacatggcccagggggtccagacaaatcatgtccactggcagagagaaagatactgaacagctacccctggtctgtgttgctgttttctctagaagtcaaaggaactggcagcctggtacagtgagaatacgaaccacaagtctgtgctctaggccccatgtggccataagctggttttcagatcttagtaggtcattttaccgctttgttttccttacctaaaaaataaaaataaaataaaaaattcaacattgtttctagctttatcactccacattctgtgttctaaatggatgtaacatttatttttcaaccattttctaccaagaagtatctgcgtatttcagggagattagctgagggccaggccaggaaggcagattggacagcagaacatacccactcagtctaggtccccagggattcctggcctggcagcatcacccattgctgggcttcatgctcctagatatccacctgtttcacccatgcacatcaccccagagaagagagactgcatccctcacacccagacagaaagattgtccttttatatttttatgtaagatttttatttttaaaaaacagccttctaagaggtgtttgctccaaagagataactgtatactgtagagagctaacatataatgtttaaggtccaggaatcagcattagcgagtgagttgggtgtaagcagaaaaaggttcaaattagttcagcttttttgatgttcatatttttgtgcacataataaaaaatctctaccctagtgttataatgagctatgctcctaatagtccaatagtcattgtacatttaaggaatgttctgtgtcatatttgggaggatgatggactattaagactttgaagagtggcagtggctgcaaataattgattggctaagctgggaaattctctgccctatgaaaccgtctctgctctcctcttcttctcattttattcaaacaaccagatggcaaataaatggatggttgaagattatagctcaataataactaatatgtttagcatgatcctatgccatgcaaaaaagatgcaatttttgcttccacagtgaaaacatttggactgtttttccaggttgcaaatgaggtttgttcaaatcacttttttaaggtttgctgccattctaatgaccaattgttatcatttttgaggttaacagaacacagagtgataaatataaatgtaacaatagattgtcaaaagtgacagcaaatattaagtaatgaaataacttagttggaatccagtgaccttttagaatgagaaggatattattgcctcaaaacaaagtcttggggacatctcactcagctcacgttgtgccctcaaaataaatcaatgtgaggatttacttcacagatatttattgagcacctactttggccatatactgttctaagttctagggagacacaggaaacagagcaggtgaagaaaaccctggtggagcatattttccagtgagagaggcagataatggataagataaatcaactaagtatatgctagagagtaataagtgccaagcagacaaaattaaacagagaatggggacaggacacagaagacgtccccatcgcagggccagcctggctccactggaaagatgatggcatctgagtccagccttgcaacaagggagccagtatgtgggttttgggggtagcaggggaagtgtgttctaaacaacgggaacagccaagtgcaaagagaaagaagaactgtgagtccggccaggcgcagtggctcacacctgtaatcccagcactttgggaggctgaggcgggtggatcacgaggtcaggagattgagaccattctggctaacagggcgaaacccggtctctactaaaaatacaaaaaagccagacatggtggtgggcacctgtagtcccagctactcgggaggctgaggaaggagaatggtgtgaacctgggaggcggagcttgcagtgagctgagatcgcgccactgcactccagcctgggcaacagagcaagagtccatctcaaaaaaaaaaaaaaaaaaaagactgcagtgaactgtgattgcatcactgcactccagcctgggcgacagagcaagaccctgtctctaaaaacaattagcttctgaatctcaaggcttgttgggccgttttcttatagtcttctgaggaggaagaatttacctccagccttggttgtcctggttcgcagagttgaatcaagttctaaatcttggtgccagccagtcgcagtggttcacagccattatttagcctgcttcctgtggcaatctggtagcagaccccttattgttgtttaagtatagcctgcacttggtgttcatcgctatttaatagagcagccgctgactgcctcataactattcatgaagagcagaaggaactagctcacacttctatttttggtgcaaggacaagctcaagtccctagtgaggtttctaaacagatctttgggatattcacagaggagtagttccccatatgtttttgtggaaatatagcttgtctaagcatgccgtaaatgcagccccccaagtaaccaaaatgctcctccttttatttgattatttgaattttttcattactctctttttaacaaaatcaacgaatgacaagttagttaagtcagtaatttgaaagagcttggagaccatgtgaaaagtcaggacaaaacgtttgaatttgggctctgcataattagcatgatgtaggtacatagcccagttccttatctgcagagcaagcaatctggttcaagatcaagtcctaagtaggaatgttgcacctttcagaagttgtctttttcatgggataatttgcttttactcaaacgaggagtatacatggatctcatcaggcaaacatctaagggggtacttgagtgaccttcactttgggataattaaagttctgtccaccacttggtttaagagtggatgagtcctcattaacaaggaaggatcggtggaggcacagccctgggactcggggtaaatggctcggttagaggggaaagcatttaaaatgtagcattgagtattcctattttggtctccactaaaagtaacacagaggtaaaccattattgagttaactaggctccagaaatctttctcaaaaccagtgttaacaacaattgagctggattgatggatgccatagattatgccattgattggattatccaagtgactgctgcttcttagaggatgcttcagtaaatactatttgaacatctagtaaagtcttattattctgtaaagactgaacaaccacccttctaatgtggattgctaattaaagtctttattgacttttttagatttttgtgcaacgtggagttttttttttaactgcaggctataactgaatccgattctaccatgcagttttactacttattttcatttacttttagagaacagctcactctaagagtaatcttctgatacacaaattttgagattaaattatgatagtaattgctttttttccattctaaaatgtactatcagttaggaaaactaacgtcagggaagctaacaaggtttgtgatttgcttctagaacaaaaataaaatgacaccagatataaatacaaatccattagtaaaactcccatccgacaaacagctggtgcacgtgctttttccctcaccatctttggaatatctggtgctttattcctcaccatcactggaatatctcacatctgacaaatgaaaatgctgttggtttttaattgcttttcatttgtttcatttagcatttacacaagaaatgagaactttctaaagattctattggtagatatagagccaatctctattgacaatttgtattttctgaaactctccagccagctgaaatttaatattaataaataaataacatttgaatgaaggaaacgttttcatagtatgtacgttttctgttcccctcctcacaaggtatttgtatatttagacaataaactaagttggtatacaggtgcatgttggtagaatgttaacactgaactggatttgttaatgcattaccccattttattcccagtaagaatacccggacttcagatacgttaagcaagcaacagcagaccctgcgaatgcacatcgacatacccagggctcagcttttgattgaagagagagacacgatggagaccattggtaagctgccctatttgccactttacacaaagtggctgccacagccatgccttctcaatccaaaccccaggatgtgggaaatattagacaggagagcgtcttgaaggctacgtgagtaccaaagctagaaggtagagaattgttcttgtgaagaagaatcagtaccagcaaatgtgcagaaaatttgacttatatataccaccatatatgccaatatgccagtcagttccaggcatttgggacagaaatccctcagctctgatccatttgggatctttccaggggaggctacggatgccactccaaggaataaacatctgtaatcgactacacatcaatccagaaggcctgcactctaaagccccaggttgaaaatccactccgtgcccccctcatcaactctgataatgcaagccttcattaaataaaacttttaaactgtacttaacacttaaacaaacacatgtctttgtacagggtatcttcccccacaccagtgccccagaaacatcctgcagctgtttccccagcagcactttgggaaaaacaccagggccctagttttagggtttcagaacagccaccctgaggttttctggcttgttcaaccagaacccaggtatcttcactcttcccagcctctttccacctgaagtccattaccccacactgcctgcctcgattattctatttattccggagtgaaataccttatatttcctttccagtaataatgagaagaatagctaacatgtattgagaattctgtaaatgtcacatagtttttataagcacttcgtgtgcattacttaatttaacctttcaaccaacatatgaaagaagtcttgcttttgtaaccaagatgtagagaggtctgtgtagctttccaaggtcacagagacaggcgcagaaccaggttccccacctggccacactcaccgccatgctgtctgtctccaatgacagctagcacagcagcaggccacctgcttccacaccaacaggctgcttccaagaaaccctcaaccagaagttatccaagcttttgagtgcccatggaaacaccctgaggcaggctccgaggctgcctcttttcaaacctggctatgtttgttttggaaggtgtttgctggcatgagtcccaggacaaccctttcttgtggtctggataaactgcctgactctcagcacatagcccagctgcctcctgccgggaaggcagtggtaagagaccaggtgggcagaacacctgctccatcaaccatcacccttctgctgccccacccaccactggagacatcttgacctaatggctcctaaattctaaggcctgggttctcctggctgaagtcacatttggtccaggcatagcagcacttaaagattggtcaagtgcaaagtggctcttgatcagctaacttcagtgaaacacttcagttaaaccatgtatgtgaggtggcactacctgccctaaagtacacaagattttattagcttgcttgtatcaggacaagggataagctactatgttttgcttttgattatctttttttgggaaaggggaaggtatacctggaatctcttttgtttcacccagtagattgggcattaaaactgaaaatttcctttgaaaaaatttcaaaaattagaatgtaattcctttgaccatataattttataagccatttatatgcattatttaatttaacccttccagccaacataggaaaagtttcttttgtaactgagacacagagaggttacatagtttgtggaggtcaccatggttatataacacgttacaatatttgctaaatgcgtctcactagacaataatcctacatatggctatgaaaatagatagctaggcagatgccatgagtggtctatggccttccaagagctggtcactggggggcttaacaccagaggaagcctgccagtcatttccatttgtaaatatgaccgttcgccagagatccatcccagtccatgcaggatcatgtatcagcaagagcccttgacctccttgtgatgcctgacaatgggtcgatggcattttctaattactgggaagtggaactgtggtgcttcaaaatgctctgggctctgaccacaagaatccaatattacagtgacattaatttccagctagaatgaatggttaacctcatgatcagacaggcgcccaaaattttccatgaaaagtgtgtaacctagccccgcagatcatctggtgtgatctaaaagggcctgcctgctagaaactgtgacatatcccatcattaatgaaaaacaaatgtagacacggagcctctcgtgctgggtccagttgtaggaagctgtctctgtggaagagccaccctctttgaggagtcgagtgaccgccacggggccggacctccaagccaagcccaggcgcctgctgtggtgccaacctcaccgcaccatgcgctgggatactcacagacatcttggcagcctttcctctatttctctgccaggaaattttattctaactttgagaggctttcctttcctgccagagactgagtaattggattttgtaaggttcattctgttcagagccttttttgggcacagaagtcgagctgtgttgtttacgactttcgcatccctgttgcagtgtcagggcagggctgcagtatggtccctgctgactgataaactcttagcaacagcatcctgggctgcaatctttgaaaatttatgaaaaatctgtatatcctagccaaagtctcccttggagtaaaaaagctttttaaaaagtatgaaacatatcacaaggtagtaatgagaatcctggcccaccaaataatgacccagctcaaacagcagctcctgctccaagcactaagatgcccagaacccatccaaacccaggctcctgcctcgctcaccttcaagtgcccacggcagtaggacttgggaagtctgacaagtgaatcatgtaggagaagtcagttaatggatgttctagagtgcttaaagcttacaggaggtgggaagaaaaggaacataccttgagtcctttaaaatagagcaatcaataagctctgaagactggcatgttttcttctcttttatttcccctccaaacattagccaagttcagaatgagagcaaacctcagtagagagaactgtagtggcgattttctagtcctgcaaacagagcttcccagcagccaaagggacctgtcttcattgacagcctcatcactggtgagggggctggcatcgcagatgatgtctcagagaagcttttgacaaacacataaatccagagttcaaatcaatgttagcttaatgaaaagccaagcccaaagagaaaagagagctccttctctgcatagtcatggttcttcttagctcattgctcccaaagccaacccctaggaagaagcttctattcctagcactctagagtaatgctaattcagtgcttgaattttcaatcatttttgtcactttagatggggctattattgtggttgtcattaacaataacacaagtgcctcaggagagaaaaggccagggagtggttggaagggagataaacgtgtttggctttctgtgttcctgccatcctgtagatgatcgctccacggttctgttgacggatgctgactttggagaggcagctaagcagaagtccctgacggtcactcacacggtccattaccaatcggtgtctcaggccactgggcccttagtggatgtttcagacgctcggccgggaacgagtgagtggtcaacaatgcttaaaatgtgtgggtgttaacaatgctgaaaacatagtaatgttctttctctctcaaatgaaaatgtgtggcttttcatacctatgcctgagaaacaaatgggtataataacatccctaattgggataatgagctgttattgatggatcttggctattattatgtcagttgaattactgttagtattggttactataaaaagtgctagaaatttcaggtacatgtatttatttttttaatttaagcaacacagaaaaggaaaaaagtaatctactttagtgtgtatctgctgtatgccagtattgggatagaacgatgatgtcatgcacgttatctttgcaacaatcctgtaagatacctactcgtgaagcaggtatcatagcctctattctgcagatgagaaaactgcagcctcagataaattatgcaaacagtataaagttgcacacataagtagtaaaaccaagattcagaaacagacccatctatccccaaagcttatgcttttgcccctgaacacactgtttgagaaaaattataattctagttaatgtgaagattatgttggattttgttattaatatttgcatccataatatatggaaattaattactgcaatgaaggtgaatcccctaatatgtatctagagcttattaattagatactcttatttcttcataattggaatcgttcctaaatctctttaaagactgagaaattgatgtcctgattattatcattttggaaactttgacgtctagctttcaaatctctaatcaatttctttgcaaaaatttacattcttagaatagtgtgttattattagaaaaataactattataatgttaaaagctattcttcataaatcctagcttgggaagcatttgcgaaatgcagtgagctttatgaagtaaacccattgcctacgaaataacattgtaatatacagaaaacagtttcagcaggcattgaaattcatttaaaaaatgttttcaagaatattctacattctaaagaagtcttttacctcttccttttgtctaatcttcttaccgcctttcttctttgatcacattaatacattctgaagacataaacgggatatgagtgggaattagctttgcaaaggggtgtgtgccagagccttgctcttaaaaaatgatccagactgggcgcagtggctcaatcccagcactttgggaggccgaggcggtcggatcacgaggtcaggagattgagaccatcctggctaacatggtgaaacctcgtctctactaaaaataagaaaaattagccggcctggtggcgggcacctgtagtcccagctactcagaaggccgaggcaggagaatggcgtgaacctgggaggcagagcttgcagtgagctgagatcacgccactgcactccagcctggacgacagagcgagactctgtctccaaaaaaaaaaaagattcaagggctttgacatctcttcagccgttggcttctcccttgtgaactgcctggtgtggcttgctgctactccaagacactgctccaatgggtttaagagccacttttttgctgctaaatcagaaaaagttacagatattgaaaggattagatttttagagtgatgcagcattggcttcagcattctgttggaaacggtggcagaagagcaggcaaaagagacaacagagcagatgccctgggtctcgttctccacctttacatgcatcagaatcacctggtgcctatttaaatatcaattccaggcctccacccagagattctggcctaggaatccgcatggtaacagacaccctgggtgattctgatgctggccgtttggaccccacattgagaaacactgccccaagggttagaaatgtttcctgcatgtaacgcagcagggcaggacccctccggcacatcagttcttcctgccaggtaaaaagcaacatgcatttctgcttccctgtcaatggtcagctagcagccgagaatgcataaagctagtcataaatagttaagacaggagaagcagcagcccaaaacaaaagcactggcaaccttccagcttcatggtcagccccagaataatggggaagttgatttgttggcatgtaaaatatcaacagagacatgaaccggagtcacagcagatactgtaaaccagtggtcagcgagtgccaggcaggacgcacatgggagggacgtgtgtgtatctcatggctataaagttggaagcagggctgggaatgttaatgcgttcattcagcactcaaaagtatttattcaggtttcactttacgtatatggctcagtgctgtatgatggagatacaccatgagtaagatgcaaaaagacattcatttcatcctagtcagggggcagacattagacatggaactaaagtagttttcatttctcagtaagtcctagacagaaagagaatgaagccatggtgagtcagcgggcgtgtggagcagtgggaggggctctcttgggtccaagtcattcaggaggacttccagtgaggggaagacatgaaacaagatcagagtcacagcaggagcagagggggcagcagggaaaagctcccaaggttccccgcatgatgaggatggaagtggcactggagcacagtgaaaggcagggaaaaggtgagacagagaaacagctgtcctcatctttcagggtcccctaagccagtgcctggcaggtgcatttcattctgagagtgctgagatgctgtccctggggcttagcctgatgatcacagggaaacactatagcttatagaacaatgtttctgtcctttgtgctgaatttcactaaatgatgtttaccaacatcaagcaaatctactcaaatgcatgcatcagtctctggttcccccctcactctccaaattgagcgtattaatttagcatttgcagaaccctctgtattagtaaaagatctgctggatcatttttttcattaaatcttcctcaaaaaccacagtgtgagggactgacaacactccgtgttttatttagagttagaaatggtaggtgactggccccacagtgggttcaagagtctgaaacccatgaactttctgaagcacagtcccccactagcttcttgcaccagagcttctcacctctgcccaggtgtttatacctctgtgaattccatggagccggttcttctcaccacagtttggcatacttgcagagaatcatttgtattctctattttctcagctagagaacacatcgtgattctattttgtatgttaggactgtgttgtcattgcaagaattctttatttttaagaaaagcatctaaaacatgttgcttgcataccagaatgactgcattgtagaagttatgtttctaggcattttattagtttgccagagggttgcaacagattcttatgaggatggaagaaatcataacaatttgctatttatctctgtcagtagtgaaaacacatcccttggctggttctgctgcactgattacttctctgtctttcctgtggattataatacactggaaaactaggactctatccatgtcctcatccccataccagccacagtgtctgacacaggcatgtagtggataaataccaatcagccatcaagttctgagatcagaacaatgggaatggaaaagaaaagacattgagtcatgtttgctgcataggaatcatgggcacggccagctgtgcctgtgccatgtgcccggagcacttgggcacattaatctcatttaaacttcaggacagctcttaacgtgggtgatgacatcacctagtctcagagactaggggattagtcaggtctgtctgacaaggtcacttggccagcgacacagccagggagtagtgaatatgaacttccagcccaggcagcctaattccaaagctctcactctcagtcattctacatggcctttaggtagagatactacatatagaatatgtagagactaaagaatagacttcacatgtacgcacattcaatgacaagagcttacaacatggacttgaatctttattgctgagactttgaaagaaaaaatgccctctgttacccaggatgggactagcagtggccctgagggaaatacctggggtgggtgaggtgcatccagtggtccaggatgtaataagtgctagataaatattttttagttacatgagggagtgttcagatctcccagtttcatcctctctctgagacaactagtaaattcgttatgtaaagctggacctccacaactgcaagatatggaaaccaatggcacagatgaaagcagattaataccatgatcacagtacgcatgacatgttctgtaacctattatattatctacaaaatcctctctcatcccaaactcaggataattaaaataatctgattcaatgggcagaagcttaattagggttcaaaccccatgttgaaaggccatgagctatttatatcctgtgccctccaactcatgggctgctgagcaggcatgaagcttaatcaccgagttttatttatattagaatgctgggagcctaacaaaatactttccatgaaggagcagtaaatcccagcgtttatttgctcagtagatgagctagtaagttacacaaaaaaggcttcctgtggaatccaagtaaaaattatattttagctgctatcttagtcattatcatacagcagagttcagttcaggtacaaaacaatggctccaaaaaccaaattattaaaaaataaatgtgtcaaataccccagtattctacatactgaggcaattttgaccctaggatgcctgcctagcgcagtacagaactgagggctgtggtttaaggaaactaatatcatgacctaaattttcaacattatcaggccaccagtaaaactgtcctcatctagaaaaaaagagattatgaacaaaattaacttgaaaagagaccaggctttgaatcaaggctgcatgtgcgactttcccatggaattttccaagtagggtgatctcaatgaggaaaggggctatgacagtgaagatctttgccccaccattggagagtgagctcaagcagaagaaatgagggtcaaggtttgggggattggaggaaatgactgtatccttgaagtgggactagcaaactataccccccaaccaccccccaacttccatgccagaagtaaacctgctcagaatgagctacaacagttgtagttgcaagaaacttaaagaagaataaaaatgagaattttcaaaacttatgtaagggactgggtaattttctggaaaagactcattagcatttaaataacaagcttcacttatttaagctccacttatcaagtcgatagtgcctggaagacatttagcctcttccccatcataatgtttttctgtctttttgagggcctctttcctagcatttcggtgaagaaacccaattatcattcatacctggttgtgtagagctccaacataactcatttacattctcatcaaggacaaaaaaaatctaatgaagtcttccgtggaattgtgcaagtaagggatgaaatgtgtcttaaaatcaatgccccagagaatatttaccaagattgagtattctgatgatttaggagatcttaaaatctatctctttggctgccatcttaacgcacctctccagcgacacagaatgatagattagattcaaagtcgaattaactagaaacttgcagtgaggaaatctcccgtttaaaaacaaagtcattgcaccttcccagtgttagcctttcacattccaacatggaattataagcaagccaaggtcatgtagacacagcactaggaaacttagacactcaggatttggccatatgtggtcaagtaacaggcgttatctgaactgaaaaggcagaaggtttgggttatagttttatcacgtaacagctatgtcacttctctctgagcttccattgccttcataaagtgaccctaggtctatgaattccttcagaaaactctgtatgtcagggattattgtaggctctatgaatggatccacagagggataccattgcccctgccctggagacactgccaggctcatgaaagcacataaataaatcggtgcaataacattacaggccggccctgtcagttttgctcctttgaaacttcgtgagagcccaacagtgaatacagtctgctgggtttagaagtggccagaccatactgaaatataactgtatcaaactgctctttgagaagcagagaattcaaaggtagaaaagacccatctaggaccttaagctgtctccaggctggagccccagaaaaatcattccaggtaactgaacctctctcattttccacagaattccagaagaggcgatgttgtagcccattctggtacctgacagtctctgctggtggaacatccttcttcttacctcaccaaagggttgagctaagaactccgtccaccccatagacttgctgcctttggttccagatttagagaaaatgaaacccatctggcaccagcttaaccctttgttctccatattaaataacccaagttgtctctgttaaagttaggacaattctattgaagagatgtgctatcataggcaaggccttaaggagagttgggacataaaaatatggtccctctgctttaggagctttcaacttaatgaataaaacagtcatcattaaaacaatgagtagtaatatgagaaacaaaaatacaggcaacatctgtattaatttcctagagctgttttaacgtagtaccaccaaatgggtggcttcacagcacagaaatgtatttgcttgcagctgtagcactccagtctccacctgcatcatcccatggccctctcccctcctgtgtctgtgtcctcttcttaaaaggacaccagtcacagtggattaagggccaaccctattccaatatgaccttgtcttagctaatttcatctgtgatgaccttatttccaaaccagatcacacattctgaggtcctgggggttaggacatgaacatgtcttttggggggacgtgattcacgcataacaacacctaaggatgtagaaaggaggtcatgttagaacacactgggctgagcttccttgttttacagaatatgacgatgcccaggaagtttaaatgatgtgcatcgggtcataacattattttttgtactatcatccatttaattgcagttgcaaacatcgtaaccaaagtacctctctcaagtcattctctagcacagtaattggtttcattttctttataatcttcatcactgtttgaaattttcttgttttgtcctgtaattgttgtcagtctcccctcattccatttctagcttttaatgttagaagggtcataacattattaaaggccaagagcaagactcaaatatgtaacttctgaatccaagtagggtgttcttttccctgcagggctgattaaacacgtaagtatcagatgaaggtttcaagccataaaggaaagggaaagtatcctctgcacaggagaagtcaaggaagttttcctggagggcgtgggcgagtcggcagtgctgggtgggtggcactgacctctacgcttgctctcagctgaccacactcctgcagacaaaggcagacatgattcttggctcttcacagatcccaccaccaggaggaatgccaaggctgggcccacagcgagaaaccgctatgccagccagtggaccctcaaccgaccccaccccaccatctcagcacacaccctcaccacagactggaggctgccaacacccagggctgcaggatcagtagacaaagagagcgacagttacagcgtcagcccctcgcaagacacaggtaggccctgacgctgcctcctccgtccctggggaccagcacggcccccgcaccttgagcttcatgggctccttggggaggggagagagggcttcctccctcttacttatgttcttttgaaggtcactttcaaattgttacgcggtttatctaacagttactaatacaactgcacagcctttactccacacagggcaaaacagagccaaactgcatctattctgcaggtgtcctgaatcttagacccaagcttatttctccatttagttcctaccccactgggagaaatagagacatttttaaattttcacccccgtgattgcagtaattgctgattacactctgagggcgtctgacccattaccatctccaagattaagacacagcacttgaagttacatgatgaggtcatagcaccctctatagggaacacaggctgatccgtttgacaattaaacaggggttggttataaggtaagtcatccagtctatgccatcaaccaccaagttttcacttcagagagaagacaggccctaagaatagcaccgggttgcccaccaccccctcttaaattttgaaaagaaattacatctgaatctaatagctgtaggaaattttaatactcatttttcttttgttcttgatgatatacttcaaaaacagtgttccagaggaggatcatcgccatgtgaatttatttttaaggctgtgatttctcttagaagagtctcagagttccacacagaggagaccctaaaactttttagtgcatttgaaacgcagacatctccctgaccaagatggcgtggcccagctcaaaggcatgtgggcaccagtttttgtcctgatggttttctagtccccataaagggtaatcacaacagaagacgcatcccaggggtcgggggccattctggcttgtggccaatttccgtgcaacatgacatctttatttctaaatatcatcacatcttccttcctgagctgaggccccagaagctgaactgcagctcaaatcattcatgccaattaaagagtctctagggcatagatccatttgcaggttggagcagagagggggctgctgcctggctcctactgttttcactaaaagcaggattttttttaaagggaaggcgttatttatttatggaaatgtcccaagctgggacatctgactacagcaatttggttgcaacaaagcttcccttaaccggatctgctgagacttgtgaagctggcctcagagtgcctaaggcaggagcctccgccaaggagccagaactcctaccaggtcccaccatgatctggaagaaaacagccccaagccaggaagggccatgccgttggttcagacttctgatggtgagtcgtccgtcttgtttttctctttcctggtgtagatcgagcaagaagcagcatggtctccacagaaagtgcctcctccacttacgaagaactggccagggcctacgaacacgccaagatggaagagcaactgaggcacgccaagttcaccatcacggagtgcttcatatcagacacgtcatcggagcagttgacggcagggacaaatgagtacacggacagtctgacctccagcaccccttccgaatcgggaatctgcaggttcactgcatctccccccaaacctcaggatggaggaagagtaatgaatatggcagttccaaaggcacatcggccaggtaggtgagcaaggccacctgggggccgtcgcttagggaagtgcaccttcctggtcctccctcatctgctgtgaaagcccttctcagtgttcagaccaaatgggtgctctgtttatggatggctgcataacaaaccatcccaaagttcactggattaaaactacagcagtcacttactttgtttatgaatctgaaatttgggcgggacctagtgagggtaccatgctgcagaggctctcctggggctggggatccacttccaaagtggctcaccgacctggctgtgttctccctgtgctggcctctccacaaggtgctttagcttcctcacagcatggtggctgggttctagcagcaaatggtccaagatacagtctgtggaaatagccagtttccttaggttgggcctggaaactgacacagctatcatttctgtcatattctattgggcaagcagtcacagagcccaagaaaccctgattccagagaaagaggcccccactgcttgatgagaagactgtcaaaaatgtgagggctgtattttaaaactgccacactgagggcttctgaaaggggagaggtcttactatatagtcagtgtttgggacttggcctcactgaattacacaaggtgatggtaactggctaacattaagtcagccagcagtttggtcttcaacttgaacacctgtgaatcgtccgggttgtgaaagctgcaaattttgaggtcagcaaggcatggcagataatagaatgcagaggctagagaacagggtcaaaggagcgaggcggacatgggccatttcagggttcactactgtctaaaagaaaagactctagcaaggccctgccaactgatcgcaagtggaaatggggtcttagtatggacttgtgttttaagagaagccggaaaacttggttttatatggaaattcacagctttttagtgttggcttggatatttgtaaaccattgtacagggcaaataaaacccatctttaggtggaatccaacctatggcagccaagtgtagttctcatctgaagaaccactttttctttttcaccctgaaatagttgcctgtagactttccttcacagactgatctatccaatcttattgaatccagttttgtttctcattttacccattttctacaccactgttctagttccatttcaaaaagtatcttcacttttgaattactacaattcccttgggttttatgggacaaggcctagctgaaatgagctttataaatgcataaaaatatataaaataagaatagtttatccagcaaataatcttccataccagctcaagattcatgccagcatccaataaagaatgatggcttcctttattttcattctgtctacctccttaggggaaaagacaagctgttatttgtgggtgtttttatttcaactattttttttttttcgtgttgttggcatttatttgcaaggcaaatggagaaaaatgcaggataaatgccatgactttctgcagctcttcagcctgaaggtgaggaggactggagagaagaccataagcctgtgggcatgttgtataggcgttctcagcttcagttcctgcatctgtaaaatgggaatggcgttggtgactgtgtactgggcttctgttagatgcacatagcattatacaggtgaaggggtcagcagaggaggcactcagccatgttagccattgtttctggcactgggttgctagaatccccactgtgactccagctgtactgctgacctcctcttccttcttgcttttatttttctccagtgaccactgaagtcctagcaggtacccacctcaattgtgtgtcacccagttaagtactttatgtttccacctgagatagcatgccgtcattttccctttgtgtgtgatttagggcacagaatgagcttctaggttaaaagactgtcctatttgtgcaggcctttacataattacagggttgaagcttgtttttgatggcacgctgctcatattgttggattgtttcttaaaaatttgacctttgctcatgatattgtgacctggacccattagagcaatggaagatcatagctaagttactattgtcttcatagactattcagagtaaaatgattttataaatataggtttgaataatctcttaaatcaatgcaagttcaaatgtccacaaactttgttttgtctaccctagatgactgcattattactgaacatctgatatgctttagaaaatatttcagcctttggaaacctttccgtcgctcctttataattcaactaaattcaacattgggcacaaaatacaaggttgcagtttactattctgctaactagagcttgtgatacaattagcagctcctagagctgtgcttttacatcacattctttccctatatgccctcttcacgctagatgatattcgtcatgtctgtttctgtttatagtcttccaaatctctcaatttcttcctcctcaactttagagcttcttttctgatggtcctttttttctctttccctttttattttttctgtcttcagtacaaatagttatgatccccagactttgaaattctctgcaaattgccatcaagttacatgaatttggccagactgtggcttcagaaaaataggaaatatgtcttagttatcttcatacttccttctcaaggtctagcagatacctgatagccaagtagttatcatgcaagaattatttttaaatgaattaatagtattgaatactcaatactacatacttaaaactctctctctatacataaatatatatatctcctgtgtgtgtttataatatacacatatatggccagactgtgtctggcacattagtagatgcttcataaaccttactgtatgaatgaatatatcatgcttgtgacaacaaaaccaactggttaaattggttaaaatatttcaattaatagaaattatagtcaaataaatacaaaaggacatttaaatctactccaactttcagtagctttaatcaaagtgacttattttccattctttttttttttgatttttatttcatctgcataatttaatcagtttttccttcacatattcaaaaacctacattggtatttttttctgacacgtttcccctgttagactttagtttttcttagttcatattctttttcttttcttttctttattattatactttaagtttcagggtacatgtgcatattgtgcaggttagttacatatgtatacatgtgccattctggtgcgctgcacccactaactggtcatctagcattaggtatatctcccagtgctatccctcccccctccccccaccccactacagtccccagagtgtgatgttccccttcctgtgtccatgtgatctcattgttcaattcccacctatgagtgagaatatgcggcgtttggttttttgttcttgcgatagtttactgagaatgatgatttccaatttcatccatgtccctacaaaggacatgaactcatcatttttaatggctgcatagtgttccatggtgtatatgtgccacattttcttaatccagtctatcattgttggacatttgggttggttccaagtctttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtttttggctgcataaatgtcttcttttgagaagtgtctgttcatgtccttcacccacttttcgatggggttgtttgtttttatcttgtaaatttgtttgagttcattgtagattctggatattagccctttgtcagatgagtaggttgcgaaaattttctcccattttgtaggttgcctgttcactctgatggtagtttcttttgctgtgcagaaactctttagtttaattagatcccatttgtcaattttggcttttgttgcctttgcttttggtgttttagacatgaagtccttacccatgcttatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggttggtcaaagatcagatagttgtagatatgcagcattatttctgagggctctgttctgttccattgttctatatctgtgttttggtaccagtaccatgctgttttggttactgtagccttgtagtatagtttgaagtcaggtagtgtgatgcctccagcttttttcttttggcttaggattgccttggcaatgcgggctcttttttggttccatatgaactttaaagtagtttcttccaattctgtgaagaaaggcattggtagcttgatggggatggcattgaatctgtaaattaccttgggcagtatggccattttcacgatattaattcttcctacccatgagcatagaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgacttttgtacattgattttgtatcctgagactttgctgaagttgcttatcagcttaaggagattttgggctgagacaatggggttttctagatatacaatcatgtcatctgcaaacagggacaatttgacttcctcttttcctacttgaataccctttatttccttctcctgcctaattgccctggccagaacttccaacactatgttgaataggagtggtgagagagggcatccctgtcttgtgccagttttcaagggaatgcttccagtttttgcccattcagtatgatattggctgtgggtttgtcatagatagctcttattattttgaaatacgtcccatcaatacctaatttattaagagtttttagcatgaagggttgttgaattttgtcaaaggccctttctgcatctatgcagataatcatgtggtttttgtctttggctctgtttatatgctggattacatttattgatatgtgtatattgaaccagccttgcatcccagggatgaagcccacttgatcatggtggataagctttttgatgtgctgctggattcggtctgccagtattttattgagggtttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttccttcttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggattggtggtgatgtcccctttatcattttttattgcatctatttgattcttctctctttttctctttattagtcttgctagcagtctatctattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctatacactgctttgaatgcgtcccagagattctggtatgttgtgtctttgttctcgttggtttcaaagaacatctttatttctagcttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaatacgtgtggtgtggtgctgaaaaaaatgtgtattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttgaagtctgttttatctgagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagactgtgtcttttaattggagcatttagtccatttacatgtaaagttaatattgttatgtgtgtatttgatcctgtcattatgatgttagctggttattttgctcgttagttgatgcagtttcttcctagcctcgacagtctttacaatttggcatgtttttgcagtgactggtactggttgttcctttccatgtttagtgcttcctttaggagctcttttagggccggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgctgagagatccactcttagtctgataggctttcctttgtgggtaacccaacctttctctctggctgcccttaacattttttccttcatttcaactttggtgaatctgacaattatgtgtcttggagttgctcttgtcaaggaatatctttgtggcattctctgtatttcctgaatctgaactttggcctgccttgctagattggggaagttctcctggataatatcctgcagagtgtttttcaacttggttccattctccccatcactttcaggtacaccaatcagacgtagatttggtcttttcacatagtcccatatttcttggaggctttgctcatttctttttattcttttttctctaaacttcccttcttgcttcatttcattcatttcatcttccatcactgataccctttcttccagttgatcgcatcggctcctgaggcttctgcattcttcacgtagttctcgagccttggttttcagctccatcagctcctttaagcacttctgtgtattagttattctagttatacattcttctaaatttttttcaaagttttcaacatctttgcctttggtttgaatgtcctcctgtagctcagagtaatttgatcgtctgaagccttcttctctcagcttgtcatagtcattctctgtccagctttgttccgttgctggtgaggaactgcattcctttggcagaggagaggcgctctgctttttagagtttccagtttttccccatctttgtggttttatctacttttggtctttgatgatggtgatgtacagatgggtttttggtgtggatgtcctttctgtttgttagttttccttctaacagacaggaccctcagctgcaggtctgttggagtaccctgccctgtgaggtgtcagtctgcccctgctggggggtgcctcccagttaggctgctcgggggtccggggtcagggacccacttgaggaggcagtctgcccttctcagatgtccagctgcgtactgggaggaccactgctctcttcaaagctgtcagacagggacatttgagtctgcagaggttactgctgtctttttgtttgtctgtgccctgcccctagaggtggagcctacagaggcaggcaggcaggcctccttgagctgtggtgggctccacccagttcgagcttcctggctgctttgtttatctaagcaagcctgggcaatggggggcccccctcccccagcctcactgccgccttgcagtttgatctcagactgctgtgctagcaatcagcaagactcagtgggtgtgggaccctccaagccaggtgcgggatatagtctcgtggtgcgccgtgttttaagctcgtcagaaaagcgcagtattcgggtgggagtgacccgattttccaggtgccgtccgtcacccctttctttgactaggaaagggaactccctgacccctgtgcttcccgagtgatgcaatgcctcgccctgcttcggctcgcgcatggtgtgcacacccactgacctgcgcccactgtctggcactccctagtgagatgaacccggtacctcagatggaaatgccgaaatcacccgtcttctgcgtcgctcaggctgggagctgtagacgggagctgttcctattcggccatcttggctcctcccccccaggcacaatactttctaaaggcaccttgaagcctaaaagagcccttcttatactctgaggtatctcaccactgaaactggttacatacatctgtattgggaattaatggataagggtggaacaaatgaaatgcatttctgggggccagatattccaaagcagtttggggtagccttcttcctcctcctctgcaatgctttgttagttggaggctgtaaacatgccgatgctttcccaaatttgtgggaatgaatgtgaatcacagtttttggggcttcaatctcctctgcggacacataaaaaggaactttcatcaatttctaacaaggtttgagatctatgcctggatagagctggatattgatgcaaaagtaagaagcaaaagatgatttccttgagttccagcaatttcaataaaaaacacagagaccagacttgcaacaacactatagtgtcaaagagctggttcccaaaggggagcatagagtccacccataccagagacagacgagatctaacactttttgagtttaatattaatgttgcagcatggtaatgaaaactagtaaaagaatctctcttggtaaatgaatcttcactcccaaacggcaagcaggaaaaaccctaaataaataatgtgagattgatatcagaggcccatgtgcagggactcgattacaattcttggcttgtactcaggggccctcatgcattttttaagagctcatcaatattgtgatccttctgcttgctggtgaactttaaaaactacaccgaggtataaaagtagggctttgactttgttgaggcttatgattcttctcaaataaagtagatctgaataaaagacggattggaaaatcttccctggcctttaggcaagcacagaacttagcagtggttttggagcacccactatggaacgatccatgagatccaaagatggatacagttcccacacaacagccacaaggaaccacacattggggaccacctgaagcagaaccctagctgggggcttggccttgttctgccatgaagctgacagagctgtttctacaacaatgtgcatcttgaatcatcccacagaaggagctgagttaggctggaaatgagagaattccagacagagggaaggtatatttgtggagttgtaggaggccagaaagttgaaggctggagactaggggcaaggttggaggctggagaccaggggtcaaggcaaggaagacaaggctgacccctcagacgctagtaagtctctactgtgagagcagcaggaagccatggaagggggttaaacagaggaaggttgactcttactggaaatgatggcttgtctcccatttctggtttgggatacaggatgccttaggccctggtgccagcagagtgtacaggaggccacattggaagacgatggtctttgctgtcttcttacctttctgtatgctccctgggccttcgtgtggctttagcttctcacaaggcctcactgggctgtgtatgtgtgtgcgtgtttgtgtgtgtaggtggtgactgaccatcttctatgagctgggctttgtattatttcttgaccttctcaagatttgcctgtctcatgtcttcagaacccattgcctgcagtctttgatacacactattctgataaatgaatgagactgtgaggagtgttaatttaagatattaacccttttatgtgttagggtaatacccagtgtctttttactcaggagatattcaatcagtagggattcaatacacgagtgtcgtatatttgtgttttaaccgggtctgtctgagatgcagtgaacgttcagttagcctgggcagccttctttcttgtcatctgtagagctggaatctgggagcttccttctggtcactcagcagggacaaagaggcctctacccccacatcactgttctctaaggtacatgcctcccccatcactttccacctctcgaggaactggcacagcccaggatttcgcaatgattagaactgaaccccaataagctacccaagaaaaacagtgagccttttaaggggctcagaagtcagacaagagaatcagaacacagggaatacatgttctggaacaagaggacacaaacaccagcttagcaactgcagcaagtacagtgaaccagccagaccaccggacaaggtcagaggtacaggggatggcctcttgaacacagtggcaggaggatggttgcagggtagtggctgcagaagaccccatgtacatacatgctaagcttttatttcaggcaaagggcttagagttctaagcttgagaacccctcagaacaggtcctactgtcactttctgagtctgagggagagttactaagaagacactgaaattctataagagcccttaagaagctaaaattgcaaatactcctcagagagacctggatttccagcagaaatcaggattagcacatgccaatatttaggtcgacatcgagtgggcgtgaacagcagtatgtggaggctttgttggatggccccagggttcttttaacctaaaattctatgggagtgtttgaagggtcgtagttcagagggaactcttgatccctgttgtgaacgccaagctcattcctatctcctggcctttatctttgctcagctctctggaccaccagaaggatctttgcagggctccttccatcccatcatttacgtctcattgcctgagaggcctttccgggccattctttccaaaatactcccctcccacgttttatccccttcctggatttgcttctccacccagcactcaccacagtcgggaacgatactatttgtttgtttacttgatcagtggggatctctgtgggtcttgtctatcaatcactgcatcctcagttcccaaaacaggaccagtcatttagtgtccactcaacacacgcatggcaaaaaaagacagaggagcagggaggctgagagggagggagcaagccttcctctagaagggtggaacgcagagcagtgcagtgagaatgtgtgtgtgcctgtgtgtatccatgcatgggagcatgtgcttatgtatccacgtacatgtgcatgtgtgtcaacatatatgtgtccatgcatgtgtacttgtgtgtgaatgtgtatgtgtgcacgcatgtgtgtgcgcaagcacacgtgtaggcatcaaagagacttgcatttgaaaggagacccttagtataatatttatgataaacatttcaaaactgagttttagtgatgtgcagaacagaggaggaagatgcaagccccgaggcttggcaccccagctgcctgagccaagtcctcaggcagtgagggagatataggtaagtgaagctgggggtgggggttatttagctctgaagattggactgctggtgtcttgttttgatttcagagccaacatgacagatacccagacttcagagagggaaaacagcatggtcaaaatgacaactgagaatacggtggccagccttggtcagaatagtgctgacctgtgcagaggtaggctctttcttcaggtaagggctcctggcctctctgcatgccttggggcccgcctcctactctccaccctcacaccctcaggagagagtgatgcaagatgaatggatcctaaaattaaaatccagtaactctttcgaattactggcaatttagtgaattaacaagttggcaccaggcagtggccttttcccactaaaaaaaaaaaaaacaacctcaaatgcattccccaaggaaggggctgaaactcataaccttgtgtctggggcccagagggcatgagcacagagatccaaaggggctgatgctttccctaccactagtggggcaggctgtgttagggtgcatgtctgaaacttgaaactgaattaagtagcttcatgtaatggcttctcttgacggcacaggataaacatcataagaagaagaagcagtaatccaagaaggtttgcaactggctcaaaatgctacctgaaaccaagaattggaagccaccttgacccagaggaaaaaaaattgttaaactttgcagctatttctcaaaagaatagagaattttgttttctgtttgtagagatgggaatagtcatcccttatggaagaagacaataatttgctgcatttttaggacttgtaattgtacaggcaaattcaaaattcaggtagcattaaaattacagctagataatgctgcctgctttgtggatagctatcctcatttcaagggagagcacccctttatctgttgaagagatgtctttttgatttgctaagggcaagaatggaaaataagtgcgaataggaacagctccggtctgcagctcccagcgtgagcgacgcagaagacgggtgatctcggcatttccatctgaggtaccgggttcatctcactagggagtgccagacagtgggtgcgcacactgtgcgtgagccgaagcagagcgaggcattgcctcactcgggaagcacaaagggtcagggagttccctttcctagtcaaagaaaggggtgacggacggcacctggaaaatcgggtcactcccacccgaatactgtgcttttctgacgggcttaaaacatggcgcaccacgagattatatcccgcacctggcttggagggtcctacgcccatggagtctcgctgattgctagcagagcagtctgagatcaaactgcaaggtggcagccaggctgggggaggggggcccgccattgcccaggcttgcttaggtaaacaaagcagcctggaagctcgaactgggtggagcccaccacagctcaaggaggcctgcctgcctgcctctgtaggctgcacagacaaacaaaaagacagcagtaacctctgcagactcaaatgtccctgtctgacagctttgaagagagcagtggtcctcccagtacgcagctggacatctgagaagggcagactgcctcctcaagtgggtccctgaccccggacccccgagcagcctaactgggaggcaccccccagcaggggcagactgacacctcacagggcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaactggaaactctaaaaagcagagcgcctctcctctgccaaaggaatgcagttcctcaccagcaacggaacaaagctggacagagaatgactatgacaagctgagagaagaaggcttcagacgatcaaattactctgagctacaggaggacattcaaaccaaaggcaaagatgttgaaaactttgaaaaaaatttagaagaatgtataactagaataactaatacacagaagtgcttaaaggagctgatggagctgaaaaccaaggctcgagaactacgtgaagaatgcagaagcctcaggagccgatgcgatcaactggaagaaagggtatcagtgatggaagatgaaatgaatgaaatgaagcaagaagggaagtttagagaaaaaagaataaaaagaaatgagcaaagcctccaagaaatatgggactatgtgaaaagaccaaatctacgtctgattggtgtacctgaaagtgatggggagaatggaaccaagttgaaaaacactctgcaggatattatccaggagaacttccccaatctagcaaggcaggccaaagttcagattcaggaaatacagagaatgccacaaagatattccttgacaagagcaactccaagacacataattgtcagattcaccaaagttgaaatgaaggaaaaaatgttaagggcagccagagagaaaggtcgggttaccctcaaagggaagcccatcagactaacagtggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcactaccaggcctgccctaaaagagctcctgaaggaagcactaaacatggaaaggaacaaccggtaccagccactgcaaaatcatgccaaaatgtagagaccatcaagactaggaagaaactgcatcaactaacgagcaaaataaccagctaacatcataatgacaggatcaaatacacacataacaatattaactttacatgtaaatggactaaatgctccaattaaaagacacagactggcaaattggataaagaaagagtcaagacccatcagtgtgctgtattcaggagacccatctcacgtgcagagacacacataggctcaaaataaaaggatggaggaagatctaccaagcaaatggaaaacaaaaaaaggcaggggttgcaatcctagtctcggataaaacagactttaagccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcatcaagtggacctaatagacatctacagaactctccaccccaaatcaacagaatacacatttttttcagcaccacaccacacctattccaaaattgaccacatacttggaagtaaagctctcctcagcaaatgtaaaagaacagaaattataacaaactgtctctcagaccacaggtcaatcaaactagatctcaggattaagaatctcactcaaaatcgctcaactacatggaaactgaacaacctgctcctgaatgactactgggtacataacgaaatgaaaccagaaataaagatgttctttgaaaccaacgagaacaaagacacaacataccagaatctctgggacgcattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagtagaaccgaagcaaatagagacacaaaaaacccttcaaaaaattaatgaatccaggagctggttttttgaaaggatcaacaaaatagatagactgctagcaagactaataaagagaaaaagagagaagaatcaaatagatgcaataaaaaatgataaaggggacatcaccaccaatcccacagaaatacaaactaccatcagagagtactacaaacacctctacgcaaataaactagaaaatctagaagaaatggataaattcctcgacacatacactctcccaagactaaaccaggaagaagttgaatctctgaatagaccaataacaggatctgaaattgtggcaacaatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagataattttagaccaatatccttgatgaacattgatgcaaaaatcctcaataaaatactggcagaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaatgaagggtattcaattaggaaaagaggaagtcaaattgtccctgtttgcagatgacatgattgtgtatctagaaaaccccactgtctcagcccaaaatctccttaagctgataagcaacttcagcaaagtctcaggatacaaaatcaatgtacaaaagtcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacgaaataaaagaggatacaaacaaatggaagaacattctatgctcatgggtaggaagaatcaatatcgtgaaaatggccatactgcccaaggtaatttacagattcagtgccatccccatcaaggtaccaatgcctttcttcacagaattggaagaaactactttaaagttcatatggaaccaaaaaagagcccgcattgccaaggcaatcctaagccaaaagaaaaaagctggaggcatcacactacctgacttcaaactatactacaaggctacagtaaccaaaacagcatggtactggtaccaaaacacagatatagatcaatggaacagaacagagccctcagaaataatgccgcatatctacaactatctgatctttgaccaacctgagaaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaaaggcaacaaaagccaaaattgacaaatgggatctaattaaactaaagagtttctgcacagcaaaagaaactaccatcagagtgaacaggcaacctacaaaatgggagaaaattttcgcaacctactcatctgacaaagggctaatatccagaatctacaatgaactcaaacaaatttacaagataaaaacaaacaaccccatcgaaaagtgggtgaaggacatgaacagacacttctcaaaagaagacatttatgcagccaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggacctagaactagaaataccatttgacccagccatcccattactgggtatatacccaaaggaatataaatcatgctgctataaagacatatgcacacgtatgtttattgcggcattattcacaatagcaaagacttggaaccaacccaaatgtccaacaatgattggattaagaaaatgtggcacatatacaccatggaacactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaacatcacactctggggactgtagtggggtggggggaggggagagggatagcactgggagatatacctaatgctagatgactagttaatgggtgcagcacaccagcatggcacatgtatacatatgtaactaacctgcacaatatgcacatgtaccctaaaacttaaaataataaaagaaaaaaagaaaagaaaatactgctaaaatacatccaactcaatacttttggtaaatattacttgttgctaataaaaagtttagatataagaaaaaaaaaaagaatgtattgtgcctcattcatttgtctaaaggcaagagcaccaaggctcaaaagggtcacaaaactacctggaggcagaagcagaggcagagacaggatttcaacaccaagccctgcactctgtaactactgctctttccactggaatcagctcctgcctcagcgggtgccaatggagaaagacctgggggttttgccttctgattacagttccattggaccatctcttattttcttccatgaagaactgaggtcgtaactccttgtggactagtattctgaggctgaggggtacaactgcttatcctggttgaattcaatgctttataagtagaattaaagtgaaataaggaacacttggccttatgaattctgatcatctaaaacagagtttctcaacagcagcaccgttagtatttgaagccagatcattcttcgtggcaggggctattctgagcattggatgatgttgagcagcacccctggcctctgaccaataggtatcaatagtgtcaccctcccctgtgttatgacaatcaaaatgtctccagactttgctacatgtcccctggggacaaagccaccctcagtggagagcctctgatctagtgttcagatattttcccctagtgtggtgcctgggagatagcaagaaccatagcaagaaccattgtttgatgatggattaatggaatgcacatccattttctgaattgcttcattcttgttatttcagtattgattttgccatccttcttccaagaactgaaatacattcaaaccttgcgtgtgtctgaatagattgagaaaattcaggaagttttgctttcctaggtttcagctaaaaggaggcaggtttagttcagcagttttcccacagtcaggccaaccatggttctaatgcaccgttagtggagggggacaagctctgagtgtgaatctgctgatggatgtggggcctgcagaaggaatctgtacatttcaggaccagaggcaaggaggagcttgtgatactagtatgcaaagtggttagagaaagagagagaaatcaatgctgacctatttaatcagaacttttggagacattaatggcactgaaggtccccagagggcagcaacagaaggatgagaaatgaagcatgatgtcaaataagaaagcaaaatgctgcaataatgggtaaagcgtctcatcctcaaggcggaagtcaaagcagctgcctgggttccctccagaaaggcagtgatgggtgcagcctgtgatctgcactgggttttggtgaggctgatgagaaaagaatgagaaatgggtgccccagtgatggatgggccagtggtccttgtatggtgcacacatctttaaagctccacaagggccgttcaaagtgggtggtacacatttattctcatagtactcacctttctggtgccctcttcctccactgctccttaccactgtcccagatggttaccatgttccccttttcccttctctatttgtgactctgtctctaatttttatctgtctaccgacctgcgtagctatgtttcttttctttttttttttttttttttttgagacggagtctcgctctatcgcccaggttagagtgctacgtttctttctttctgcctccctgtgtgtgtttccatctctctgatccctctctctctctctgtgtgtctcttcccctctctctcatccatcctccctcacacccccccagccttattcatctcagcctcccctgaccctggtatgttcctgcatctcagtccctgaactcagtttcccagagcccttctctgtgcttggccatctccaccttctccatccctcaccctcacttagggtctctgacaggaagggcattggcctcagggcagagcacagtgggttcatggtgtgcaaatccaccattacagcccaaagaagtcagcagggggaccctgtcccaaaggcccaggcaggactctgtgagcctttgtattcatgctgggcctgggctggagacactaactgggtttagctcactgggaaggaaccggcagtgcgggcaggtaggtgagcagggcagaaggagggcatggaagtgagttcaagctcagttcctcctgccgtcagaccatgagctggatcctcctaccagcgctagtcctttccttctccatgcctcaacttcccctttcagtatgctgctcttccagttagattttccctcccatatctctctcctctctctctctctctcacacacacacacacaccacacttttcttgatgtgtatgccctgcttgctgtcttattgcactcagctacctctttgtccctcccctgcttcatgtttttaccccttttctatgcctttgatttcgtggatagaagttttagcacaagggaaacaaaacaaggaaaagaaggaaggaaggaaggaagttagttttcatgttgcctgagactgggtaatttataaagaagagatttaatggactcacagttccatgtggctggggaagcctcacaatcatggcggaaggtgacaggcacatcttatatggtggcaggcaagagaaaaatgagagccaagtgaatggggcaaccccttataaagccatcagaccttgtgagactcatccactaccatgagaacagtatgggggaaaccactgccatgattcaattacttcccactgggtccctcctacaacacatgggaattatgggagctacaattcaagaagagatttgggtggggacacagccaaactatattagaaggaaaataaaggaaagaatggagggaatgagagaaagagataaagagacaggaggaagggaaagaaggagggagaaggggaaggggggaaatgtggagaaaggttgagggaagcaaagcagaggaagtgaagtgacaccatagagtatggaaatcattgccaaaaatataagtgaattttgtcatagctggttttactgaaacaagtactaagactgggcatttgcctttgccagtgtttatggcaatgatagatttacacacagggatgccgagggcatttgcacccagtggaggtgagtacccatgacatggtgacccaatatggtgaccctggagttcaaagcacaaaggatccttggacttcttctggatccctgctacttttcactgcatgggagaactggagagggtcctgaatggtaagctgtggggcaggtgagctggggagtaccagacacacccaagaaggccctgctccctgtggaaacagattccttaatccagggaaagctttcacatgcattatctaagttactcttcaccacagccctctatgctagattctgctattactcccattttatggataaggaaactgagcccagatctagacctgtcagataaatgcaggcaatgttatcctggcctctattcctcatcaccacaattaaagccaagggctggtttctcccatgtgacacaggcagatggcaggcagggcactggggaatgctgtgccaatgtccccatggtcaccacagtctcacacatcatgtgtctctttctggatcaataactgcatgagttgtcttgctatgtgtaggcatcttaagcatataggaggacaattagagaatccaggtcctcagaggctttgttgatgagcacatgggctggggttttaaagaacataagtgcctgtaataacagagcttaccgctgactactctggtgctctcttctctgtaagtgcattaattattgagagaactcatttgcagcacgcacacagttgaaagggctactttggacgctaatcagaaaatacacattgttgaagggagctaattagagaatcacacaactttgtagagctttgcctgaaaaactggatcaatcagagatattggatattcagagatacttgtcagacctgcaataaacaaatacatgtaggcattgcatgtaaagatgtaacactgagctgtttccattaggaaggatttttatttctcatctgtccatttcagtgactggagccctcttgataactacatctgaagtgggagcccctgcaggcaggatgcagatattatgagtcctatcttttgatttcaaacacgtttcttccttccaatctaagacctgcgcattctgcagtccagccgggaccacaatgctattactttgtggaggtttaataagccctgtgcattcaatggggagtcactaaaatagagatttatccccaaatctgttgcaacacattacaaatatgtcaagcgttcgtgattgagtcgggtctcagaaagagcatgaggcattcttgacctatatatttaaagaaccctggaggtaaatgtctgtcccatttcctcaaatatacaaacaacatgataaaaataatattgaataaaaataatttaaaatttaaaataaataaataataaaattaacaatttgtttatcagattcttaggaataaagacataatcactttcaggagattgaatgtataaaactacaaatcgcaagactggtcaattaaggtgtattgattcacatacaaaaggatgttcacattacaaaagaattattcaattttttcttaatgacagctctgttaatgctttcatcactttttttgcaaataatccctggttagagaagactgaagaataactaccataaacgaacattagtaattttcaatgccatcaagtttcataaagttttaaaaactcaaattctttcaggaacaaagctattctatatggcaagagattcctgaaccctccacattagtgtctataatgggtaggcctcatgccattatatttttctaagccaaagttcagatgcatcaagttaccaaaaccctttttacaagaatgccaaattatgtaattccttcctataagaatgttatgggccaggtgcggtggctcacgcctgtaatcccaacactttgggaggctgaggcgggtggatcacccgaggtcaggaatatgagaccagcctgaccaacatggagaaaccctgtctctactaaaaatacaaaaattagccaggcgtggtggtgcatgcctgtaatcccagctactcaggaggctgaggggggagaatcgcttgaaccgggaggtggaggttgtggcgaaccgagttgcactccagcctgggcgacaagagcaaaactccatctcaaaaaaaaaaaaaatgttatggcccatttattgtctaggtatttattactgagcttcccttggatccagttgacagtaggaagccaacgttgaattagaatgcctttaatttcagtgagcccagtccagtgtcgctggggtcatttagtgaattacatgctgccattcccagtgaaatcatataactactcatcatcacttagtagaataaagatatcctgaaaaagctaaatggagttttgaatcataaatcccaagtggtgcaacaatgtaataacacaatgacaaagaaatcatttgctgcatttcccaaaaataaggtcattgctcctgttgttcgcggaaaaaaattttcaagacgggtaataacattttgaaaatttgtatgctcatttaaattgtataaaatgcatttttagggcttgatttggccatatttatttttagttctcttatactttttttttttttttttgagatggagtttcatccttgttgcccaggatagagtgcaatcgtgcagcaacctccaatgcgcaggttcaaaagattctcctgcctcagcctcctgagtagctgggattacaggcgtgtaccaccacgtccagctgatttttctattttcagtagagacggggtttccccattttggcctggctggtctcgaacacctgacctcaggtgatccattgcctaggcctcccaaagtgggcggggattacaggccagttctcttatactcttgaatagtcctttccttctgttatgctggttgttctttttctgtgggtaaacttgaaggtgtttcctaaggttcaggctttaaacactgtctaaacacatatcactttcattgccccgctagcagagcagctggctaatggcagccctcacttggctcaggtggtctcagatcccctcagcctgcaccttcggggcctatgggtccaaaggggctggatgaggaaggctcaattaattattgttagcatacagtaacataaggaaagcaggggatattttgaagcaaaagaaacaagaatgttcagttactttagactcagaaaacgagcagtgagtcatcctagagctacgtttctatgataaaaatacctactagatatcttgtcttgaatgtccccagctgcatcaaactcagcaggtctgaaactaaacccttcatcttttgtcatcaaagtacgatctttcccctatacaccctttcacagttagtgatttcactgtccacacagtttcctgagcttagagcctgggaaggagtcacccctaaccccttctcctctgtcaccactcccacttgtcattgactctgaagccaccttccttggacccccttcatatctcacaatttaattccctctctcacatcccacagctgctcctgagctcagaccatcatcatatctctctccctgcacatcctttaccctgggccctcgctccaggaccacacaccaccagcccattctctagacagagttttgcacctggtatgtcacgagttacaggtgtgccaagatggtgagtccttcagacctcaaggtggccagaaacagctccctgggttcatcccagtgtactgcacaaataccccttgtctgcctgttcctcaaaaagtgggaagcactgggctggataaggcacactgtctgtaccaaaacagcagaaactcagacccagcgtcagtccagctcaagtcaggcagtgttggttgcaaagtggacctggtggctgggccctaattgtgctcatgctttgcaaggaggtgatgggatatattaaagccttgaaacagggccctgaagatgggaatgagaaggagtcaaggccaggtggctcatgtctgtaatcccagtgctttgagaagctgaggcaggagcatcacttgagttcaagagtttgagaccagcctgggaaaccaagcaagaccctgtgtctccagaatattttaagaataataattagccaggcatggtggtatgtaactgtagccctagctactctggaggctgaggtggaaggtttgcttgagcccaggagtttgaggctacagtgagccatgaatgcaccattgcactctagcctgggcaacagagcaagactctatctcttcttgtttaaaaaagaaaaaaaaaaaaaagagtcaagagatattttgccggtagaattaacctggagagaaaggtgtcagtgaaacctctgaggtttcaaggatggaaggatggtgataatgttacacaagatggagcacacaggagagaagcagtatttgggattgggaggggatggggttggccttcattaactgaattggtagactgtggccttcagaattccagatggacactcgtgtggaaatgcctagcaaagcacctaaaattcacatctagggctcaggagaaagagcaaaatggaaaagatagatgggaatgttatttataaagcaatgaggaaagcagccaagccttccgagagaggcctgagagcaggccactgaacactccgtatttagaggaaagacagagaaaaggatccagtcaaggaaagtgagaaagggtggccagaaatgtaggcagagatctggaagaccacagtgccctggcagctgaaagggccaacaacaaaaatatcaacggcatcaaatgctatagtaatgcaggtaggaagaggacgaagaggaaaccagagaatttggcaatgagaggtcagggtgacctttcagtagctgatggtgaaagaagctgtgtcagttcaggtttttgagaagcgcctagcaagacagattagacacacaaggaatttattggggaaattcttgtgaagaaggaagcaaaaggaagcaggaggtggcaaggagagtctggagaccataacagaggtccgacacctgtgagaggagaaggcgaaggagggattggttggaggcacgtcaggctgcggtgcacttctgagaaggctgcagtgaggctgatggggtatccctgagcaaaggatgcctgttagggagatcctgcatcgggcggggacggccatgagaaaagccctgtcacgcttgtcattggcttgcagcatcccagagaacacatgcctcccttcctgcagcagatgctcttggtttttttgttttggtttgggttttttgtttgttttgttttgttttgttttgttttgtttgagtcttgctctgtcacccaggctggagtgcagtggcataatctcagctcactgcaacctcctcctcccgggttcaagcgattctcctgcctcagtgtccccagtactgggactacaggcgcccaccatcatgcttggctagtttttgtatttttagtagagagggggttttgccatgttggcctggctggtcttgaactcctgacctcaggtgatccttccgcctcggcctcccgaagttctaggattacaggcatgaggcacaccgtgcccagccagcagatgctcttgaaggagacctgaggttatgtttgcgtggcaccacagaagccagagtgaccataagcaggaagtagaaacactagaattctggtctaagctgctgtcatctctatacacagcatggctgaaacagaagagccacgcagaagttagcaggtaggcagggcctggtaagaaggccataagctgtggcgctttcacccaaagccatcatgaagacccataactaagtggctggccaaggtcacaaggtttcatagaattgccaggacgagagccagctgtccatcttcgcttggcgtccctggctctctcctcaaaccctgtgctctccctgtacttccaatcacatgcggggtttggtctatcaccgttcgtacccagtggacactgatgcctttgatgtatgtttttctttcaacgatggtgtgttgaaggattctgttacctccattcctccatttctgtacaagtaagttaatacaagtaagtaagtactgtaggaaaatgagctcctcccgcgcccagggaggaggtaggaggacgattccacctgtctttgtggtgagcgctgaaggaggatcttgagaaaggcacctgtgtgcagcggcattctcatctctaaagcccgcatggcttcccgtgtgcacacaggacattctgcccatgtttaccaaatgaagacaccaactaactaccctgtctttccttctaggtgacctcatacatttgcctccataccttagaatggactttttgttaaaccgaggtggtccaggcaccagcagggacctgagcttaggacaagcatgcttggaacctcagaaaagccggaccctgaagcgccccacggtcctggagcccatcccgatggaagccgcctcctccgcctcctccacgagagaaggacagtcgtggcagccgggggccgtggccacattacctcagcgggagggagcagagctgggacaggcagctaaaatgagcagctcccaagaatcactgctcgactcccggggccatttgaaaggaaacaatccttacgcaaaatcttacaccctggtataacagacagcatgactggacagcggttgtaaatacaattcaaacaattcaatcaaagctaccttttttttacggaattccaatatttataattaaagaaaattgccaaaatatattaaaaaaaaaaaagagaaaatactgaaaccacagacagtgcaaagactctcctgctttttttctgtctgagtgtgagctccatccgcctgggcatctgattttttgggaaagaagtccagttttatgatcttcacaggctattgcatttttactgattttctacaaaagtgcatgggggggattaattaaaccttctgactggaagttctatcacacaagaggcaagaaagaaaacagggtgggtgggaaatcagcctatttgtgaatttaaaaggaacaccgatttgcgggcaggggaaaacttcagtcacgtttgcacacctttctttcccattagaaaccgggttctcaatttggtcttcttttgttgttaattaggatgagtgccgtcagtgaaggggtggggggaatcaatttggttttctctcttgtttcttttttaatttaatgagacactctttgcattttgtctaagcgaaataaaaaagaaaaggttgtctgcct

SEQ ID NO: 2 - DNA, 175795 bp, Homo sapiens
tgccgggccgggctttcgcaggcagtgggaccagagccgggaggggcggcggtgtcccgggaaagcggctcttggggcatccgggtcccctcgaggcgggctccggacgtcgccgtgggcggggccgagggcggggcctggcctcgttgtggagcggctcgtaatccatcatggcggccgcggggtttggtgtctgtgcctgagcagcgctggagccggagccggttcccgggtcctgcggctgaggagcccctccgctgtccacggcccctaccggcggggggcggctgggtccctcggcggagctcgggagatgtgactgcctgagggcggtggtggtgtcagcgtccggggccgggggagggggtgtctcgggcagagacccccgggcttggggcagctgaggcggccgggcctcctctacacggggcccgccttccgctgtctgggccgcgagagtccttcgtcccttacagccccgccccggctttgggacactgcgggtggtctgtttcccccagcttgggacaccccgttttctgaggcgtggaagagcgtcgccccggagtaagctgcccgtgccgcgccccgacagcttccctcagccccaagccgccccttattccggatcccggccccaactttggccacggagcctcccattcaaatccctcccttgctgtcaaggggtctccccttcccccaaggtggctcccgcgagcctctaatgccctgacttcttccaatgtcacctacggcccccttagtctcagctcagccaaaaactttaatgcaaaggaaaagtctggattggttccacaggccttttaaaaagcggacttaaaagttgctggcaatgcattccttttcgtcagagtcgagggcaaactcgctgaaatctgggtgacccgtgtccttttccggagagcaaagcagagaagcgagagcggccactagttcggcaggaaatttgttggaagatgaagaagctaagatagggggttggtgacttccacaggaaaagttctggaggagtagccaaagaccatcagcgtttcctttatgtgtgagaattgaaatgactagcattattgacccttttcagcatcccctgtgaatatttctgtttaggtttttcttcttgaaaagaaattgttattcagcccgtttaaaacaaatcaagaaacttttgggtaacattgcaattacatgaaattgataaccgcgaaaataattggaactcctgcttgcaagtgtcaacctaaaaaaagtgcttccttttgttatggaagatgtctttctgtgattgacttcaattgctgacttgtggagatgcagcgaatgtgaaatcccacgtatatgccatttccctctacgctcgctgaccgttctggaagatcttgaaccctcttctggaaaggggtacctattattactttatggggcagcagcctggaaaagtacttggggaccaaagaaggccaagcttgcctgccctgcattttatcaaaggagcagggaagaaggaatcatcgaggcatgggggtccacactgcaatgtttttgtggaacatggtgagtgcttttcaaaatttctgctcatggttttcctcatgcattcatcttaggccttcaaggaactttgaacaacagtacttgcgacagttccttccaattccacttaataaatttgttactgtagttatctcttagtggaactttctttgtataagaaaaagttacttcgtgacttcggctttattcaaaatctatttgagttgcttatttcttgcctgattcctctgctaattcactgttgaccttggacaagccactttactgttccagggctttagtttcctgaggggctggacttcagtggtttcttagggtccctggttctatgattctgctctaaccgaagtcgtgggctcttctgacaagcatggattctttactgctttgtctacagagagcttttatcatattctcaaagtggtttgtgttcctgagaaagttaagaatcatagatactggttgacgctaatatccttgaccttttccttcgtaagtaggacttgaaaatactcactttggagccatgtgggaaaaatcaagtggggaagcagcattccttgtgaattttagatagacagcttctgtcttaccttccataaggagtaatctcttcctcgttgatgaagctttcatcctgtcttctccctgtttagaatgatatttgggccaataaaggttatctgtgacatttttatgaacatatttggcatttgaatgctgcccgtacattttatgttgttcatgtccagtaattctgtgcgaagttaaagctaagggtcggcttacactgatgtctataaccagttaattagggttactgtttgtactgttgcagcctgacattttttggattgtgtcctttatattaaaaaatcagttgagcccacctatcctataagcaaacgtatgaagtgtgccagtggcttatactttgaaattcattcagaaataccccaacattgggtgactgcagtcaacaaaggcttctgttggatgaacttgcatttgacagctgaagttttactttcttacgggaaaatattcacttcatctaaataaatccgggtgcttggattttactttgccttgaaacattagttctattttagctttgtttttaggcaggcaaatatggtaatgtgttgttatgatggttcccaaattcaggatttaaaaagtgaattatttacattttaactagtgatgatcatgcaccttacatagtgaaaattggaacagactttttggagagctttggcggaacttatcagaatttgaaatgtacgtgccaatgacccagtaatcccattctgggaagctagtagagaaagcagtgtagttccctgtgtgtccctgatatctcttcaggggttgagaggctaaaactattttcttgttaatagagtaccaaggtcttgtctcttttgctgtgttgacgtttgcagtaatggtacaaaagtaaagcaggtgtcttagcatgattcagggttgtggcacctaactatacttgtagtcattgcattcttcatgacgtgcactcacagttaaacaaactaaatatatatatacacacacacacacacatatatatccacttttcactgaaaaatgtccttttttttttttttttttttttttttttttttgagtcagagtctctgtgtgtcacccaggctggagtgcaggagtgcagtgtggcgatctcggctcactgtaacttctgcctcctgggttcaagcgattctcctgcctcagcctcccaagtaggtgggactacaggcacgcgtcactgacgcccggctaatttttgtattttttagtagagacggggtttcgccatgttggccaggctggtcctgaactcttgacctcaggtgatccacccaccttggcctcccaaagtgctgggattacaggagtgagccactgcgcctggctagttttcactggacaataccttgatgaagcagcaaaaattattaattttattacattttgacccttgtgtatgtcttcttaatattctgtgggttaaaaaggggggtatgcatcaagcacttctgtacagtaaagtataatgattatctccaggaaaagcactttggtggttgggttgcaaactgaactagccacttttttcatggactgccatttttacttgaaactatgacaaactatggttattcagactaaaaagtgtatgaaggaatctttcaaagaaaacaacaggtagcatttgttgccaatgatgaaattttagctttccagtgaaaattaggattttggagaattttttttttttcctcttcggggtagagtttcgctcttgtcgcccgggctggagtgctgtggtgcaatctcggctcactgcaacctctgcctcccgggttcaagcgattctcctgcctcagcctcccaagtagctgggattacaggtgtgcaccaccatgcctggctaatggagaatttttatctgcctctgtgatatagagattggtggtaatatttacagatgccatattttaatatcttataatgaaatgtattatttggaagatctacataaatcagtaaatcaatattttcttttttgttcgtttttgcgacagagtcttgctgtgttgtctaggctggagtgtagtggcatgatctcggctcactacaacctccacctcccaggtttaagcaattctcgtgcctcagcctcctgagtagctgggattacaggcatgcaccaccacaagtgaataatttttgtatttttagtagagatggagtttcaccatgttagccaggctggtcttgaactcctgacttcaaatgatctggccacctcagcctcccaaaatgctgggattacaggtgtgagccaccgtgcccagccaaaccattattttctaaatgatcaatgcatgatataaaatcatgcacaggttaaagatccattcaaagtgcaaaatggaggccaggtgctgtggctcgtgcttgtaatcccagcactttgggaggccgaggcaggtggatcacctgaggtcaggagttcgaacccagctgtgcaatctagtgagatcttacctctacagaaatttaaaaaattagccaagctcccactggagccaaagagtcgaggctgcggtgagccatgaacacagcactgcattccaatttgggcaatagagggagaccgtgtctctggggggtaaaaaaaaaaaaaaatacagttcattggtagagtttcttaaaggcagccagcctttaagaaattcctggctaggccgggcacagtggctcacgcctgtaatcccagcactttgggaggccgaagtgggcagatcacctgaggtcgggagttcaggaccagcctgactaacatggagaaaccctgtctctaccaaaagtaaaaaattagccgggcgtggtggcacatgcctctaatcccagctactcaggaggctgaggcaggagaattgcttgaaccccggagcggaggttgcattgagacgagatcacgccattgcactccagcctgggcaacaagagcgaaactcttgtctcaaaaaaaaaaaaagaaattcctggctgggtgtggtggctcacgcctgtaatccgagcactttgggaggatgaggcaggcggatcacttgaggtcagtagttcgaaactggcctggccaacgtgatgaaaccccgtctgtactaaaaatacaaaaattagatgggcgtggtggcatgcacctgtaatctcagctactcaggaggctgaggcaggagaatatcttgagccccgggggaagaggttgcagtgacctgagatcgcaccactgcacttcagcctgggtaacagaatgagactctgtctcaaaaaaaaaaaaaaaaaaaagaaactaccatttaccatgttttgatgtagcatcaaagaacaatatctacggttatctagaaagtctgttttggggggagaaaacagttattttccagtaataaaaatatttgtttttaaatgaataattatgtttttaaatttcagtattcatttctaatgtggtaactattgatgagataacctacacaaactaagcctcttaggggccttcggttatttttcaagagtgtgacaagggcctgagattaaaaagtttgaggccaggcactgtggcttatgcctgtaatttcacactttgggaggccaaaggcaggtggattgcttgagcccaggagttcaagatcatcctgggcaacataagaagaccctgtctctacaacaagaacaaaagaaattagccagacgtgttatcacacctgtgttcccagctacttgagtggctgaggtgggagggtcacttgagctcgggaggccaatgctgcagtgagccatgatcacgccactgcactgcagcctgggtaacagagcaagaccccatctcaaaacaaagtttgagaactgttgctatggaaagtctatcaagaaggcacatagggatgtttgttgctgaagtactaacactgaatgatgtctgtgttgtggtgagtagaaaaaaagcaatttgaaaatcattatttatggtatggccccatttttgtaaaacaaaaatatctgtttatttgtgtatgtccaggaaaaaaaagtatggaaggattttacaccgaaatttttatctctagggacttggagctttaggtggaatcggagaaaactttctctttttggtttgtgtgatgttccaagtgtctttttacaacaaacttgggttatcttataatacgaaaaattcgaagatttaaaaactgaggccaggcacggtggctcatgcctataatcccagcactttgggaggttgacacatgtggatcacctgaggtcaggagtttgagaccagcttgaccaagaaggtaaaaccctgtctctactaaaaatacaaaaattagctgggcgtggttgcaggtgcctgtagtcccagctactcgggaggctgagacaggagagttgcttagacccaggaggtcgaggttgcaacgagctgagattgcacgccactgcactcccagcctgggcgacggagtgagactccatctcaaaataaataaataaataaaaataaaaactgaattgatgacagcccaacctgtcacttttttcagatccctttttatgaaagaatttgcttaagttgtgtctgaagacaaaccaatttctttggaccctgggtattctttttctaagggaataccatgttattttgtgttacagattgtttgcgatctttcataggctgatctttctagagttggttaatatccatgtaggttagattgaaaaacttgaattcagaaatgtacggtgttggagcagacatggatctggaagccaagaatagcgttggtgttgttgttgatggtgaatctgaaagagtgggcagatggcaactttttgccagaatcattcagggtcaaagggctagtcatatttacaagggaaaagaggaaaccatgttattaaatatttcatgcaccatatgttcctttcaaatttcagtggcttgactaagaaaattcacttttgggagagttggtacaacaattgaaagcacttagtagtcaactttttccttagtgtttccttcttccttcaacaaacatttattttattgagcacagactatgacaggtcgtgttgtagtcactgatgatatatttgtaaacaaaacaatccctgccctcctagaacttacattctagtgggaggagacacatcataaataagctaagtaaataaaatacagatatgttagtgatatgtgctgaggagaagaataacatagagaaggggacagggaatggggtaggaggtgtaattttagttagggtggctagagaggcctgactgagagggcggcatttgattaaagacccgaaggaggaagatgagcagcaggccctgttgaaatatgtgaaagaatttcaggccgagggaaccaggatgcagaaacctgaggcagagcttgctagtttcaaggagcagcctagaggccactgcaccagagcaaagagcaaaaggagagatgcaggaggtaaaatggagggtgggaagagaatggctgaaggagagggtggccttattggcccatttcaaggattttgactttgattcatatgatgtgggaaggccttggagaattttccgaggggactatactatctgatgtatgtttcagtatgaaatagaatctctctggctgctatgatctgaaggaggacaagggagcagggattccacgggggcattgattgcacagagccaggtaagagtgatgatgcttggaccaaagtggtggcactgggtggagggtcagaaccgacaagatttgctctcggattagatgtgggatatgggggtgtgagaggggccaagtgtgactctcaggttttcgaactgaataactggaagaatagagttgccttttattgaaatgaaggtcgaggctgcagtggtaagctgtgattgcgccactgcactccagcctgggcaacagagcaagaccctgtctcaaaaaaaaaaaaaatatttaccatcaggtaaaaccacttatggttctcaaaactttatttaaaataatagacacttgataaatcaacactgtaggccgggcgctgtgactcacgcctgtcatcccagcactttaggaggccaaggcgggcggatcacttgaggtcaggagttcgagaccaccctggccaacatggtgaaacctcgtctctactaaaaatacaaaaattagtcggcatggtggcacacacctatagtcccacctacatgggaggctgaggcagagggatcacgtgaacctgggaagcagaggttgcagtgagccaagatcatgccaccgcactccagcctgggtgacagagcaaggctctgtctcaaaaaaacaaaacaaacactaattctcattactcttaaaattatactaaggccaggtgcggtggctcatgcctgtaatcccagcactttgggaggccaaggcagatggatcacttgagcccaggaattcaagaccagcctgggcaacatggcgaaaccccatctctactaacagtacaaaaaattagctgggcgtggtggtacacgcctgtaatcccagctactcaagaggctaaagtgggagaatcacctgcgcctgggaagccaaggctgcagtgagctgtgatggtgctattgcactccaatctgggtgacagagtgagaccctgtctcaaaataaaataaaataaaattatactaagtatctgtatacattagaaggtgggaggaagtgcaattattggatcctataggcattaaagttaaatttgtcaggtttttttttgtttttttttttttttttgagacagagccttgctctgttgcccagactggagtgcagtggcacaatctcagctcattgcaacctccacctcccgagttcaagcgattctctttcctgcctcagcctaattttttgtatttttattagagacggggtttcaccctgttagccaggatggttttgatctcgtgacctcatgatctacctggctcgacctcccaaagtgctgggatttcaggcgtgagccaccgtgcctggctatccgattctcaaagaggttatttggacaggctgggcgtggtggctcacgcctgtaatcccagcactttgggaggctgaggcgggtggatcacctgaagtcaggagttcgagaccagcctgaccaacatggtgaaaccccatctctactaaaaatacaaaaattagcagggcatggtggcatatgcctgtaatcccagctactcaggaggctgaggcaggagaatcgcttgaacctgggaggcagagattgcagtgagccaagatcacaccactgcactccagcctgggcaacagagcgagactccatctcaaaaaaaaataaaaaggttatttggaaagattatatccatctacttaatgctagggattggattgtggcacgtggactgtgaaaatgcaaaattggaggtatgtactttattttagagacagggtcttgctttgtcacccaggctggagtgtagtggcacagtcatagctcactgcagccttgaactcctgggctccagtgatcctcttgccttagcctcccaaagcaatgggatcgtacaggtgagccattgcacctggccatgtatgtacattttttataagcattcagttgtttccaatagtctaatacattttgtatggccttcttatttttcatgaaaccttactacccattttaagaaatttgtaatatagaagaaaacagaagtttcaattgtggggtaagtaaagaaagatgatcaaagatgatttgaccaaaagagttttacttcatttaaatgaagcatgttgtcaaagaaaatgaaagtgggaaaaaatgtgaaatcattttgtatcagttcaggacagaaccgtgcttgtgcttcagatctccaagtgtgaacacactgatgtgttgtgaagtgtgttgcaaatagaagcattttttgaatgggagggagagggatgtgttaacatgatttagctgggaattaaacccataggaatgtgtcgggcatattttctgtgactagggggtaaaaagattaaaatggctactgaggatgggcttcagtaagaggaggtctcccgaaggccttctctgccctgtgcctctgcagttccctgactccttgctgtgttcgtccctgcctttttggtagttgtgcccctgatgtcactcccctgtgtgttcagatcctacctgctggccaggtgcagtggctcacacctgtaatcccagcactttgggaacccaaggtgggacggtcctctgagaccaggagtttgagagagtggcctggacaacatagcaacaccctattagtactaaaaataaaaaagttagctaggcataataatgtcctgtgcttgtctagctacttgggaggctgaggcagaaggattacttgagtccaggagttcgaggctgaagcaaactgtgatcatatcattgtactccagcctgtgtgataaagcaagaccctatcctttaaaagtaaaaaacaaacaaacaaacaaaaaacaaacctgcttaacctttcaacactctcttccagtcccccctcccttctgaaaccatattttacatctctggtcctcattaaattttctgtaacttctgcccttgtaactcttctgcaacacaaatgaatacataatcatatacttcctagtagtatttcctaatagttttatgtgagtttcatggaagagagtgttgaaacgtaggtaggtttgttttttattttttaacttttttttaacttttttttttgagatggagtctcgctctgtcacccaggctggagtgcagtggcgcgatcttggctcactgcaagttccgcctcctgggttcatgccattctcctgcctcagcctcccgagtagctaggactacaggcgcccgccaccacacctggccaatttttgtatttttagtagagaccaggtttcaccatcttagccagtatggtctcgatctcctgacctcgttatccacctgccttggccttccaaagtgctgggattacaggcgtgagccaccatgcgtggccttttaaaaaaatttttaagagataaggtcttgctttgtcgcccaggctggagtacaatgatatgatcactgttcactgcagcctcgaactcctcaagtaaactgtaagcttgtgaatgcaggtttcatctcattttctgtttccccagcataatgctgaatacataggctctccataaaaaaaattcttgataagaatgatattaaatggactaaatgagaaattaaactttttattcacttacaaggaatgaaagttctcaaatagctaacttattttcttatgtatcctaggactttttatctggttctggggtttctttcccaatgaatatacttatatatgtttattttatttatttatttttgtatttttaaaaaccagaacatttattgtgtggctaatctttgaaattcttggctgggctcggtggctcatgcctgtaatcccagcactttaggaggccaagatgggcggatcacttgagctcaggagtttgagaccagcctggccaacatggtgaaaacccatctttacttaaaaattagccaggcgtggtgacgcatacctgtaatcccagctacctgggattgtgccactgcactccagcctgggcgacagagcgaaaccctgtctttaaaaaaaaaaaaaaaaaaaaaaagcaaataaattcttgagatgaactggatgctgcaacagctgcccttttgggtttaggtgttgttcctttatggaaatccacgccgcttcattcgcccagtccctgtggcctttagtcttttagccttggcacaccagtcatacttcctcttgcgcttggcggggtagccacatttgccacaggtagacttcggaaggtgacaggccttagagccacagtggccgcacaacgtgtgcatcatattgcaacgcttttcaaacgataacgttccctttgtcatctcccttctgtgtttatttttttattgtggtaaaatatacagaaaagttaccattttaacctgtttaggtgtataactcagtggcattaagtatattcccagtgatgcagtcatcatcactatccattttcagaactttttcatcatcctaagtagaaactctgtacccattaaaaaataatatcccatttccctctttccccacttcttggtaaccacttttatgctttttctctctatgaatttgctcattctaggacttcatataactataataatacaatatttgcccttttgtgtctggcttatttcacttagtgtttttgtttgtttgtttgtttgtttttgagacggagttttgctcttgttgcccaggctggagtgcaatggcgcgatctcggctcactgcaacctctgcctcccaggttcaagcagttcttctgcctcaccctcccaagtagctgggattacaggcatgtgccaccatgcctggctaattttgtatttttagtagagatggggtttctccatattggtcaggctggtctcgaactcctgacctcaggtgatccgcctgcctaggcctcccaaagtgcggggattacaggcatgagccaccgtgcctggcctcacttagcatgttttaaaggtgcatctgttgttacgtgtatcagaatttcttcttttttaaggctgaataatatcccattgtgtgtgtatatatatatacacaccaaattttgtccatctgttggtggaacttgtgtatggtggtttttttttttttttttttttttttttgagacagtctcactctgtctcccagactggagtgcagtggtgtgattgcctgagcccaggagttcaagcttgctacaaccttgacctcccgggctcaggcagtcctcccacctcagcctctcgagtagctgggaccacaggtgtgcactaccacacctggctaatttaaaaaaaaaatttatagagacagagtcttgctatggtgtctaagctggtcttgaactcctgggctcaggtgatactcctgcctcaacctcccaaagtgttaagattacaggattgagctcccttgcgcgacctgatattttaatattttttttaaaaaagtgtaatatgcatacagaaaggggcacaaattgaatgtacagcttgatgaatgatcacaaatgaatacctctgcattccactatcttgcttaagaagtagaaaattgtgagcacacctcagaaagccttgtgcccccttccagtttcactcctgccttcctcctcctcagagataactactgtcttacgttttagcaccatcgattagtttcccttgtttttgtttttaatattcccttgttatccttttaatgtctatagggtctgtggtgatatgctttttccattcctcacattggtaatttgtgttttttctctctgtttctctctcacacacaccttttcagttagttttgctgagggtttaccaattttattaatcttttcaaaaaaaatttgttaactttctcaattgttttccattttattgatttctgctctttattttctttcttttacttaaaaaaatttttttttgtagagatagggtcttgctatgttgcccaggatggtctcaaactcctggcttcaagcgatcctcctgccttggcctcctgaagtgctgggattataggcgtgagccactgcacccagcctactttgggtttaatttgttctttatttctagcttcttaaagtagaaatttagatcgattccaaacccttcttgtccaacataggcatttaaagctgtgtatttcctactaaacactgcgttagctctatcacataagttcatcacataagttttcatgtgttattatcaaagtgtttgatttccaagtatttgggaattctagatatcttggtttctaatttaatttcattgtggtcagagaacatcttctgtagaatttcagtcttctgacatttaccaagactaattttatggcccagcatataacctgtcttagtgaatgttccatttgtagttgaaaaaagtttgtgttgttgcatgtagttttctataaatcaagttgtttcatgcttttgtttaaacatcttctatattcttactttttattttgtacttacttcatctatagctttgctgaggtttttttttttttgtagagacaaggtttcaccatgttacccaggctggtcttgaactcctgagctcaagcaatctgccctcctgggcctcccaaagtgctgggattacaggtgtgagccactgtgcctggcggtatctctcttttttactgagagagtgatgctgaagatcaacagctataatgatatattcgtttattttttcctttaattctatcacttcttttactcttaaaagcatttattccgccgggcgtggtggcacacgcctgtaatcccagcaatttgggaggctgaggtgggtggatcacaagttcaggcgttcaagaccagcctggccaagatggtgaaaccctgtctcttactaaaaatacaaaaattagctgggcttggtggcagctgcctatagctactcgggaggctgaggcaggataatcccttgaacccggggtacagaggttgcagtgagccgagatcgcgccattgcactccagcctgggtgacagagtgagacaccgccccccccccccaaaaaaaagcatttattaggaaacaggaaagactgaacaagaacaagagaactaagcatgtaactcaagaagccagagaaccaaagtaatcccacagtacacagaagagaataataaaaataaaaacaaattaagaatggaaatgatcaataaaaccaaaagctaactttgaaaaatattattgatctaggcacacttctggtaagactaatgaagaaaaagaaaaggtagaatatttagaaaaggaacaatatttagaatgaaaatataactataaatactctcagtttttgcctctttttttgtttgtttgttttttggagacaagatctcactctgtcactcaggctggagtgcagtggcaatcatagctcactgcaacctccgtctcccagactcaagctgttctcccacctcagcctcctgagtagctgggactatgggcatgcgccaccatgtccagctgattttttttttttttttttgtggagacggggtttcatcatgttacccaggctggtcttgaactcctgagctcaagcaatctgccctcctacgcctcccaaagtgctgggattacaggtgtgagccactgtacctggctggttttttttttttttcttttctttcctttttttttgagacagtgttttgctctgtcgcccaggctggagtgcagtggagtgatcttggctcactacaagctccacctcctgggttcatgccattctcctgcctcagcctcctgagtagctgggactacaggcgcctgccaccacgcccggctaatttttttgtatgtttttttagaagagacggagtttcaccgtgttagccaggatggtctcaatctcctgaccttgtgatccacccgcctcagcctcccaaagtgctgggattacaggcatgagccactgcgcccagcctgttttttttttttatagtttgtatttttctgctgagattcaccatgttttcattcattagacctgtcttttcctctaaatcctagaaggtatttgtaataaagaccgtgcctgctaatttaaatatctgagtcatcttggggtctgtttttattgattgctttttctgtacattatgagtcagattttcctgcatttttgcatgttaaataattttgattgtatgccagacatgtgggtgttatattgtagggattctcaatcttgttatctttctttaaagaagttttcattttgttttgacaagtagttaggttactgtagttacttaaattactgtaagtgactggtcgttaagttagtttgaccctgccaggtttggttttatgctttgttagtatgggtttatccttggtccagacacccggcccttagaatagagggtactctttagacttaatgcttggcctttttggggtcgaaacaaaataacagaggtgctcagcaaagtctctccaccctggatgaactggtacttgaatgtcttccagcactgtgaaacctctgtgtctgtgcagttctcagcctcacagccaccgctgtctgctaaactgcatagaatctggaagccatggacccacaggatgcctcccaccttcttctgcctacctctgtgttctgtcaccccacccatgccctcatcttctctcagatttcttgccctacaaattctacctgcctcagcatcctcaaatccaagtctttgcttcctcagttcacagagatggctgctgtcagtttaggtttcatctccctgcactgtgtttgggaaggtgccccaggcaggaagttggaagcaacatgcaacttaccttatgtttttctctttcctcaagggtcacagccttgccttgccttgcctgtcatctaatgcctgaaaacagtcgtctcaaatattttattcagccatacagttgtttaggacaaaaggatatctaataccacttttactgcattatggacagaagcagaagttcaattctgcatattctttttttttttttaagatggagtctcactctgtcgcccaggctggagtgcagtggtgtgatcttggctcactgcaacctccacctcctgggttcaagcgattctcctgcttcagcctcctgtgtagctgggactacaggcatgcaccaccacaccaggctatttttttttttttttgcatttttggtagatagggtttcatcatgttggccaggctggtcccgaactcctgacctcaagtgatccacctgccttggccccccaaagtgctgggattacaggcgtgagccactgcgcccagccagacttttttttttttttgagatggaattctgctcttgttgcccacgctggagtgcaatggtgcaatcttagctgaccgctacctccgcctcctgggttcaagtgattcccctgcctcagcctcccgagtagctggaatatggacatgtgccaccaaacccagctaattttgtgtttttagtagagacggggtttctctgtgttgatcaggctggtctcgaacgcccaacctcaggtgatccgcccacctcggcctcccaaagtgctgggattacaggcgtgagtcaccgcgcctagcctccggccagacttttaaatgttagccttgcaggtagttgtgcagtagtatctcccagccttaatttgctcttctttgatgactcatgaggttaagcaccttttcatatgtttactggccatttggaatatatgtgtacctatgtatctcttgccagttcacctcttttgtccatttttctatttatgtttattcctcattgatttttaggagttatttatattttttttcctttttttttctttgtttgaggcagagtcttattctgttgcccaggctggagtccagtggcacagtctcggctcactccaaccttgacctcctgggctcaagcggtcctccaacttcatcctcctgagtagctgggactataggtgtgtgccaccacttctggttaattttggcattttttgtagagttggggttttaccatgtggcccaggctggtctcaaactcctgaggtcaaaccatccacccacctcggccttccaaagtgctgggattacaggtgtgagctaccgtgcctagcctgtgtactctcaatacaggtccttcgttgggtgtatttattatgactattttcttacactttgtggttcaccttttcactctttatttacataattatagccattgtgcgttttcactctatctctcttttttttttttttttttttttttttgagacagagtcttgctctgtcactcaggctggattacagtggtgtgatctcggctcactgcaacctccgcctcccaggttcaagagattctcctgcctcagtcccccgagtagctgggattacaggcgcccaccaccatgcccagctagtttttgtgtttttaatagagaaggggtttcaccatgttggccaggctggttttgaactcctaacctcaggtgatccacccaccttggcctcccaaagtgctggggttacagacgtgagccactgcgtccggctgctttttcactctcttaatggtgtctttgataaaccttaattttgacttagtctaatttaatcttttatggttagtactttttttgtggtctgtgtaagaaatctttgtgtctaccctaaggtcacaaagaagtttcactctcttacatctcatgtttatagttggcctggaattgttttttctgtgtaggggcgaaggttcattttttccctcatattgacctagctgtttaattgaaaagaacatctgctgctgtgtaaatcaggtatacatgtacgtgtggatctgctggggaactccttcctgttaatttgtttgtctttccttgcaccagtattacaatgtattactgtagctttaaaataaatcttaatgcctggtagaataaggcctcctgttttgttcttcaatattgtcttggcttgctcctttgtatttccatatacattttagagtgggttttatcagcttccatacccaaacagaaatacccttaaggattttcttctctgattgcactaaatctataggtttctttgatcctagaaatgaataatagaatataaagaattcttattgatgaaagaaagctatttcaggaaacttttttttttctgttaatgataaaggctaaatgattcctgtcaattgtttcaaattttcaactttcaaaatacctgctgcttctttccaattcacctttctctattctttttttttttccaattgtatttttctttgacactcagtacttgtcccttgatagtggagaccatgtttatacattttcatggatcgaacagtatttttttttaacagactagctacttagtgaatacgcagttgaatctacttgtttggcaggttcaggcattgaacaagtactaagtgcctgttctgtatcaggtactgtgtcagtctggggtaagagagccaggaacaacatagccaacaaaaggctctttgtgtctaatttatattcctgaggaccaccactggccatctgcttgggagaatggttatggcttgaataaacagtgtggaatgggtccagggaaccggctgaggaaaggggacatttactcaacctgatcttctttgttaagcagtggagagacccctggtggagccagcagtatcctttatctataatagcttgcttttcatcttttttatatcagtggctgcctgtggcctctcaccaaatctggtggactcattttctctgtgtatttagtttttctcctggaaatgactaacagctgcttaagtccttattcctttctccaggtttctggtgctgccataatttgttctatccacttgggatactgctgtagtgggaatattgtccctgttaccatcttcaggttacaaaccttttccccagcttgtggtaaaatcccgggggtctggtggatcccacgcattttaggatgtatatgggaagctaacattataggcacagtgtttttttttttttcactgtgtccgtctgttcttcagaggagcaaaggctagcatgacctttaagtcctcctttaagagtactgaatttctgccaggagcgtggcttgttcctcaagtgtcgctaggtgaattgttattagcaaggagggatgaaattgcgaaatcttaaaaagtagagaattccttcagatttcattcttgagaggtagaaaacaggaaatagaattgctaaacagagaaggggagtgtttttaatagagatatttgtatgagaataagaggatggagccataatctgaggatgcctgtcttgtttgctctttggcttagttggatcttgggttggtttacttcctgtacaaactgtgagttagtagggactgaatttacagtaatatctaaactgattggaaccttcacttgaacagaattgagttttggcgtgttcacttttaagagaaagaaacaaaggcagccaacccagtatcaagagtttagtcaaaacaaacaactcccagatttgccttggtagtgaatagattcagcatgtttgtactttctatttcttcagtatcatatagtaatttattgtttcattggtgattttgcagcatcctaggttgcaaagaatatctcttgtggatgtgtaaagttaaaaaaaaatttttttttcttgtagcagggtctcagtgttactcaggatggtcttgaattcctgggctcaggtgattctcctgcctccgcctctcaggtagctgtgagtacaggcgtgcaccactgcgcctggctgtaaagcacttttttttttttttttttttttgagacagagtctcactcgttgcccaggctggagtgcagtggcgtaatctcggctcactgtaagctccgccacctgggttcacaccattctcctgcctcagcctcccgagtagctgggactacaggcgcccgccaccgcgcctgccaccacgcccggctaactttttgtatttttagtagagatggggtttcaccatgttagccaggatggtctcgatctcctgactttgtgatccgcccgcctcggcctcccaaagtgctggggttacaggtgtgagccactacgcctggcctgtaaagcactttcatatacttttttgtgaggtctatggtataggcaggatacgcattattcctttctttcagtaggaaaacttgtgctttgggtagtcgtgtttttagggttacattgctgattagttttagagctgtggttgaaatcaagtgtctcttgacagcttgagtgtttttcaattggaaacattactttttgaggatagactaatgcattttgaaaacatttgcatcattgaaatgagtggggtctagctttagaatttaatcaaatttttaattttttcacaatttcgtggtatgatttttaatactctattgaatattctttttttttttttgagatggagtctcgctctgtcacccaggctggagtgcagtggcgcgatctcggctcactgccagctctgtctcctgggttcatgccattctcctgcctcagcctccccagtagctgggactacaggcacccgccaccatgcctggctaattttttttgcatgtttagtagagacagggtttcaccgtgttagccaggatggtcttgatctcctgacctcgtgatccgcccgccttggcttcccaaagtgctgggattacaggtgtgagccactgcgcctggcctgaatcttcttttttttttttttttgagacagggtctcactccgtcacccaggctggagtgcactggcatgatcttggctcactgcaatctctgcctcccaggttcaggcaattctcctgcctcagcctcccgagtagctgggatcacaggcgtgtgccaccaagcctggctaatttttgtatttttagtagagacagagtttagccatattggctaggttggtcttgaattcctggcctcaagtgatctacccgcctcagcctcccaaagcggtgcaattacaagtgtgagccactgcgcccagcctctattgaatattcttaccctttggtagttgagtgttttggaatggcggtgtgtaacaaacataccttatgtatgcttttatgatttataattttatgctgttatgaaattttataattataaaattatttataatttaaaaaatttatacattgtcctacaagctttgtggcagttttacgatttattttaaaattaaattgaactttttttgttgtgtttttttgagatacaaccttgctctgttgcccaggctggagtgcaatggcatgatcttggcttaccgcaacctccgccgcctgggttcaagcgattctcctgcctcagccttttgagtaactgggattacaggcacctgccaccacatctggctaatttttgtatttttagtagcgatggggtttcaccatgttggccaggctggtcttgaactcctgacctcaggtgatcagcctgcctcagcctcccaaagtgctgggaatacaggtatgagccactgtgctaggcctaaattgaacacttttgaatagataatacattttctaatttaaactacaaagctacagaacaaacatgtattttcagaagcttgcttgcacctctgccactctgtccttttccttctcctactcctctggaaaattttttgtgtgtggttttttttttttatccttccagtgttcttttttgcaaatacaagcaaatatatatttattacacaaaagatagcatacagtatataccgttctgtaccttcttttttgtttttcccttaatagatcctcaggatctccccatattggaatatgtatatcttccttctttttatggctgcattgaattccactatcttggaagtatcattggttttccaaccagttccctttctggacttttggagtgtttccagtctttagatatgataaacagtgcttcaggggtaacgttatagctgtgggagagattcctaaaagtcggggcactgggtttaagggtacatgcgtttgtcatttctgttagtagatggattctacttggtagatagctaccattttgcgtatgtctgtgtgtatatatatgtgtgtgtatatgtgtgtgtatgcatgtgtgtgcatatatatatatatatatatatatatattttttttttttaagacagggtctggctctgttatgcaggctggagtgcagtggcatgacctcggctcactgcagcttcagtcctcggggctcaagtgatactcctgcctcagcctctctagtagctggaactataaatgtataccactatgcctggctgttttttgtattttttgtagagatggggttttgccatgttgcccaggctggtcttaaactcctgggctcaagtgcctccttggccttccagagtgttgggattataggcatgagccaccacacctggcctgtattaatatagagtaatagagatctatattggtagatatttccacattttcttccgtagacatcattctagtttacagtcccatcgctggtaatacagaggttgccttcatccccaaagcctagctaagagagtgtattgtcaagctttgggactttttccaatctgatatctaagaaatagtattttagtatggttttaaatggtaggtcttctgtgagtgaggttgaacattgttttgttttgttttgttttttgagacgaagtttcgctcttgttgtccaggctggagtgcagtagtgtgatctcggccccaccgcaacctccgcctcctaggttcaagcaattcttctgcctcagcctcccaagtagctgggattacaggcatgtgccaccacacccggctaattttgtatttttagtagagacggggtttctccatgttggtcaggctggtctcaaacttccgatctcaggtgatctgcccacctcggcctcccaaagtgctgggattacaggcgtgagccactgtgcccggccggttgaacgtttttaacatgtttaggggagatacatacttatctttctgtgaaccatctcatcaggttctttgtgtggcagatatttaaataggaaactatgtagggcctagttgattgcctatatagaatccagtaccctgtctatgccccttcactgcccaagcatgtcacaaggaactgccctattccaagctccagaggacctgctgagtaggtgcttttcaggagcttgaaaagactgtttccaggtctacccccaggggttaatttaattggtctggggagaggcctaagtatcagtttttttgttttgttttagttttttagtaaggagagactttattgaaaaggatttttgcaaggaggggaaaacgactgttgaaatagggaggacactctgaccataaggaggtgtgcaggcatcttctttttcaaaaaatgttttcagttttaaaatttaaaaaaaaatttattttatttatgtatttattttgagatgaagtctcactctgtctcccaggctggagtgcagtggcgtcatctcagctcactgtaacctccacctcccgagtttaagtgattctcctgcctcagcctcccaaatagctgggactacacgtgtgcactaccacacccagctaatttttgtatcttttgtagagatgggggtttcaccatgttggccaggctggtctcgaactcctgacctcagatgatccacccgccttggcctcccaaagtgctaggattacaggtgtgagccaccacacccagccacctggacatgtttaaagaacccagtacctcaggtttaaggagcttttatgtttggtccagactacgtttcagggaagccacaagcagagtttaaagcctgctgagcaccgagctggttcttggtgctaacagggctgagactagtgaaaaagtcatgttgaggcatctgctcagttccagtgtcttccttggcatctgcttgtgcctactgtttgccccctttgcctgtgtgttaaaacagcctctgtctcagaacagtgtctttttttttttttttttgagacagagtctcactctgttgtctaggccggagtgcagtggcacaatctcggctcactgcaacctccacctcccaggttcaagatattctcctgcctcagcctaccaactagctgggattacagatgtgcaccgccacacccagctaattttttgcgtttttaatagagatagggtttcaccatattggttaggctggtctcaaactcctgacctcgtgatccgcccacctccacctcccaaagtgctgggattacaggcatgagccactgcagtgtcctttcttgaggaatggtggtctattaggagaaaaaccaaaagataagacccgagaccaaggaaattgtagtctcaatgcaaagatacaatcagaacattgcacaagggggaaagaaatgtcatgctagtgtttgtattttaattgtctttccttatttagaccaatagtagtaacaggtaacttgggttgcatgcttactaagttccaggcagtagtcgaataacttttaatatttaatattcagaacaataaggaagaaatgaaaactaagaacttactagcaatccggagtttatatttcttgaaaagctcattacaggtagttgctggaatgagatagtttgtgtgcatgaagaagaacacacaaaaatattaaaacatgacatgagtgatggtaatacagcaggtccccagataatggcctttcattcactattgtttcattatcatgttgatgagaaaaaaaaatcaattccctgctggagctactgtctatttggaatttacacattctccagtgtcctcgtggaacttaactcttgtttatatcaattaccttgctgattgatggacaaatcatggaaaattggttttgttatatgtcattttgctcaaagccccagtttccaagaacctatcaatgacattaagtgagaacttactgtagttattccctccccattcaaaacaaatttattgtttagaggatataaggagaaaacattttttccctcagatgtatccttctgtgtgttatgtgtctttttcttttgagacagggtcttgctctgtcgcccaggctggagtgcagtggtgcgatctcgattcacggcaacccccacctccctcgttcaaacaattctcctgtctcagcctccagagtagcggggagccacccgctacaggcgcgtgccaccatgcccggctaatttttgtattttttttagtagagacgtggtttcactatgttggccaggctggtcttgcactcctgacctcaagtgatccacctgcctcagcttcccaaagtgctgggattacaggcgtgaaacactgtgcctggcccgatatgtgtctttttaggcaagcagtgcttatgttgtttgttagtggtaagctgcctttgtagctctgtgttaccttgagtgagacatgatgtgatgtttagttcgtagcatcctcagcactgtcttattcacaatcattgtcaatctaaatgcatagtccttcctgattttttttttttgaaggctttttaaaaaagtttaattgagatatggttacaatggagaaaaaccttcaggaaatataaatgtaaaaaaaatttttaagctttattatttattataaaaacaacatacatttttgtaaattattcaatcaaggaaaattgattcagaaagctatttgaaattcaatcagcatgatcaatgatactttaacccctattcaaatgaaagttatcctaattaaaagtaggtgccctaagaccatttttcagggtgcatttgggttctattgcttccacatcaggaactcataattactgtatggattttataagttgatccaaccatggtatgacttctgtgggtactggtaagtccacatcattgctttgtaataatgtataatcatgactggatgcagtggctcacgctgcaatttcagcactttgggaggctgaggtgagaagattacttgagctcaggagtttgagaccagcctccaacatagggagaccccaacatagggagaccgcatctctacagaaaataaaaaataacaataaaaaatgtgtagtcacaatgttaaagtgaatcagaagagttgctaagttatgatcctttaattgaatcaaagttttttgtttaaattggcttgctgaggagtttccagtaaattaataatgaattatgtaattaatattatgttaatattaaatgttattttaatcaggtcactgccctgcatgccaacttccactgaagtgggaatgtttcacagtgattcagtggccaattagcaatgctcagattcgccatttattgagagattcacacacacacaatcaatcaaacattcacaatgtggttattaaaggctgtaattagggggacaatgaaccacagggatggctcagaaggtcagagcactgatggaccctcaagtgggttggaagtcccttggatgctagtaagtgaggagtggctgttcctctcctggagagccgctgggcggcaattgtcatgctaggaggaggcctcagagttctcatgggcaaagattccaaaggcgccccagacatcatcagctccttgctgtgtgtatgattctccaaaggtctgcccagtatcatggtctcagccagctcttggctccatttttccatcggtggtggtactatgccacagcaggtgttattatctcaccaccttattctattagacgtatgtttatcacttcgaagaaaaacaattttactatgatctcagttgccaggctagtacacatgtgcttatcattctttgtttgcttttcttttgagtcaaggtcttgctctgtcacccaggttgaattgcagtggcacgatcatcgctcacttcagcctgtaattcctaggctgaagggatcctcccacctcggtctcttgagtagataggactacaggtgtgcaccaccacacccagatttttttttttttttttttttttgtagagaagggtctcactctgttgaactcctggtggcctcaagggatcctcctacctcggcctcacaaagtattggaattacaggtgtgagtcactgcagctggccttcacttatcactgtgaggagtaaacagctgcatggtgggcttaatgccatctaacacgagtgactccatgttcagacagtaggatcacaaatgattattatatagcaatgaatggccacaggtacatagactaaggagccacatccctgctcctgggatatcctttagtcaaagggctagaagggtcctggaggtttgccacttctccgtgttgaggtacagagttcctagactaagggactggctgcattgttatgtgtgagtgctagtcatggtgctgcctggcacccacaaatgccacagcagacccatggtcgagggagaggagcaggaataccagttaccatgccggagtaacagttacggcactgatgcaccagttaccatgccagagtaacagttacagcactggtataccagctaccatgccggagtaacagttaccacactgatataccagttaccatgccggagtaacagttaccgcactgatgcaccagttaccatgccagagtaacaattatagcactggtataccagctaccatgccagagtaacagttaccacactgatatactagttaccatcccagagtaacagttaccgcactgatgcaccagttaccatgccagagtaacagttacagcactggtataccagttaccatgccggagtaacagttactgcactgataataccagttaccatgctggagtaacagttaccacactggtataccagttaccatgccggagtaacagttaccgcactggtataccagttaccatgccagagtgactgattttgaccaagacctttgggttgtacagaaggggtgagaccatacctgtcctcaagcatttccaacctagtgtagagaaaaacaggagcaagataagaacaacgtactgaaaaggaaattggatgagggcctggaaaaaggggtaaagtgagctggttgggattggtgagtgccacagcttcctgccccttaacagatcagtgccatggtggctgtggtgtccctggcccagaccttctcagacagggcctgggtgccctttacagagcagttgggaagagaagggaacctagccttgtgaccttttgctccacagacctagtcctttgttgtggtgcgaggctcagtcgtcagcccaccgagtcatgtatgttctctggttgcccctggttttggctgaactcaaaggatggctgtctgtgaggagtactggtactttttgccacttgtgtgccctaactgtggtggatgccattttggggattatgctcagcagtgagtcacgtgagatgcacacgtagcttttcggtgattaatccaggtcaatgcccttacccacatacttctgagatgtactgatgatgactacatttaaagctttttctccattggctagaagttgagacccatttcaacaaaagcacttccacctctcctgaagtgcattgggaaaactggaggccattactagatttacagatgatgggccgtgcttaaataacccatcttagctagactccaggtttcgtcacatattccctacctgttgctgccattgagggctttctctgtgctaggcactaccaaataatgctttggtaactttggtaatttggtaaacttggtaatttggtaaatttggtaataaagagcctttattctaaagtgcaaatctaagtttggggttcagtagctcaaaactctctggtggttcccattatatagagtaacagtcttcattttaaaaaaggtcatgtacccttattagaattttgtgagcaaacaaatatgtgtgtatcgtatgtatgtttatatgtatatcagatgtacgcacattagtatgtgctattaagatactttatattatataatatatactgtataataccgtatattataaagcattcataaaatgaaaatgaagatgaaataaattgcattgtaaatatttaaaactttaaaaaatgcgttactggtacaaaatttttttgtttctaaaaaattattattaatgagcaatgggactgaatttgcttcaccgtttttttaaaatcttgatttaacatttgtcatacagctattttaacatcttacactaaagttgattcttgttttttggagacagagtttcgctcttgttgcccaggctagagtgcagtggcgtgatatcggctcactgcaacttccatctcctgggttcaagtgattctcctgcctcagcctcccaagtagccaggattacaggcttgcgccaccatgcccggctaatttttgtattgttagtagagatggggttttgccgtgttagccaggctggacttgaactcgtgacctcaggtgatccacccgtcttggcctcccaaagtgctgggattacaggtgtgagccaccacgcccagcctagtttattcttttaatagtgcttgggggaggtagcctctaagatgacccccagtgattccccacctcctggtattcctggctcttttgcaaatgtcaattctaatttggtcctaaggtctctctcttgagagtggctatagattctagccctgcccaggaaaataggtttgaatgcattggtcaggtgagacacagagcagcacagcaagacacatgaaatagcagaagtatttttattacttactgatcccagagaggagagagagagaatcctgggccaaaacctttattgggagtccagggagtttcccaagtgggtttcctagggctattatgttaccgaagccaatagttctaattgatgggtttaaagggagcaggcacaagctttgtgggggtcacgctgtgattgagacatggtcactgtagcatattcatctagtacttgtggggtcggggaacaagaggggtgagccacataggccctatgtagctgtcctgtaaagaggtaggggaggtggccatcaagaggcatggtgttaggcagatgtctggagtggccacattgagggattggaagcgggtgtgtttctatgctcccttaaggatatttttggaaacaacatgcttgctgcatacaaatattcaaacattttatctttaaaacaaattttagtactggtaacatttattaacttttttttttttcctgttccctaatttgctacccagcttttacatcaaagctcctatcacaacccttcttgtttttttctttttttccctgagacggactcgctctctttcgctaggctggggtgcagtggccacaatctcggctcactgcaacctctgcctcccgggttcaagagattctcctgcctcagcctcccgagtaactgggactacaggcgcatgccaccatgcccagctaatttttgtatttttagtagagatggggtttcaccgtgttggccaggatggtctcgatctcttgacctcgtgatccacccgcctcggcctcccaaagtgctgggattacaggggtgagccaccacgcctggccccttcttgtttttgtagcttgtcacatgatgaatgctttttaccctgggggagaccaagactttgagtaatagtttgcttttataagccagaatttgttctacacatagaaggataaaactgtcttttctggccaggcgcagtggctcacgcctgtaatcccagcattttggggggccgaggcaggcggatcacgaggtcaggagatcgagaccatcctggctaatgtgatgaaatgccatctctactaaaaatacaaaaaaaaaaattagccgagcgtagtggtgggcgcctgtagttccagctactggggaggctgaggcaggagaatggcgtgaacccaggaggcggagcttgcagtgagccaagatcgcaccactgcactccagcctgggcgacagagtgagactccgtctcaaaaaaaaaaaaaaaaacaaaactatcttttctctctggtttctttgctgttccttttcaggagagaaattacaataggattggtggcctaatgatgtaagtgccaaagtttcattcgaggttttggggtagaatgtttttcaactgtttgcttttatctgagacaaagtgggcaaggaataaaggtagagtggtgagaagggtgttatcccttcctgggaacctttttttttttttttttgaggggggcagagttttgctcttgttgcccaggctggagggcaatggtgtgatctcggcttactgcaacctccacctcctgggttcaagcgattctcctgcttcagcctccctagtagctgggattacaggcatgcgccgccacacctggctaattttgtatttttagtagagacaggatttctccatgttggtcaagctagtcttgaactcccgacctcaggtgatctgcctgccttagcctcccaaagtgctgggattacaggcgtgagtcactgtgcccagccctgggaaccttttaattgtcaactgtgtaggtgttcatgctggcctgcataatagagcgcctgctgtttgattttcagttttctgtagaaggaaaaaaaaaaatcaaaccaacaatagcaaaactcatgatacctcctggtctctctctccctctcctctgcttgcatattctggtctataacaggaaatggaacctcctggagtgaggggaaaatgaccttcacatttaggtttctcactctaaagttatttcttaaatattttagcctgagttcttttaataacagacctcagctctagttctttgaaatgcatgtgggaaaatgtttatcagtgttgaaatctgacatttttttaatctcatgaactccacaattgtctgattattaaagtcctgcttacttgactgtgactaaaattctactttcagaagagtagaatgtacccctaccaaattgaagatcaaataaataaagtggacctggaaaagtaaggcttgccattgtgtgtcaaaccagcccttcccagctgtgggctttgtacttaacggactcagaacgtgaatggaagtacagactctggaacatgtaggagctgttatcccttgccagtttcatgcttcactgtccatctcctggccaaatagagagacaagggtgacattaaaatcatgggtttatctgaattcaaatctcagctgctcacttactaacagtatgaccgcagacaccagcaaaacgtcccactgctgcttatttccaagcctttccaaggtcttctggtcagggcagattcttctttcttgttcctaaatttaaagtttcaagaatttaatgcgtttttttttttttaatgaatttaatgccttttggggggtaggttttcctaatttaactttatttttttaaattttatttttaaattagtgaacagtaaaattgactttttcaatgtatggttttatgaattttaagacatttatagatttgtataactaccatcgccaccacaggacataaaatatttccataatcccaataactttcttcgtgctattctgctctcctgcctcctggcaaccactgatctgttctcatcactattgttttgtccttttgagactgtcacagaaatggaagcatctagtatgtaaccttttgagattggcttctttcactgagcgtaatgcctttgagatccatctaaatgttgcatgtgacaacagtttgttccttttcattgctgagtagtattccattgtatgaatatggcacagtttgcttattcattcatctgttgaggatgtgtttgggttgttgcttggtggggcattggtgattacgaatagagttttaagcatttctgtactgtttttatatgaacataattttttaattcacttagcatatactcttcctctgtctgctgtaataaggtaccacaaaactgggtggcttaaaacaacagaaaattattcttccactgttctggaggccagaaatctgaaattagtatcactgggccaaaatcagggggacagcagggccttgcttcctccagagactccaggagagaaatacttcctggcctctctggcttctggaggccacctgcattgcttggtttgtgaccccttgtatcactctgaccccttgttccattgttttatttcctgttttgtaatcaagtctccctcaggctgggcacccctgagggagcatggctcatgcctgtaatcccagcactttgggaagccgaggagggcagattgcttgagctcaggagtttgagaccagcctgggcaacatggtgaaaccttgtctctacaaaaaatatttttaaaattagttgggcatggtggcatgcacctgtagtcccagctacatgggaggttgaggtgggaggatcacttaagcctgggaggtggcggttgcagtgagccaagattgcaccactgtgctccatcctgagcaagagtaagaccctgtctcaaaaaaccaaaacaaaatcaagtctccctcagtcttcctctttttttgtttgcgtggggacagagtgttgctctgtcgcccaggctggagtgcagtggcacaacctcagctcactgcaacctctgcctcctgggttcaagtgattctcctgcctcagtctcccaagtagctgagattacaagcatgcgccacaacaccctgctaatttttgtatttttgtagagacatggtttcaccatgttagccaggctggtctcgaactcctgacctcaggtaatccgcccacctcagcctcccaaagtgctgggattacaggcatgagccactgtacccagccccagtcttcctcttatagggacacttgtgattacatttatgcccactaggatgacggaggataatgcccccatctcaagattgttaatcacatctccaaagacccttttctcccatatagggtacattcataggttccagtaattaggactggcatatcttttggaggcccattttttagcctactacacttggctaaagacctaggaatgggtcactaggtcatatggttagtatgtgtttaatttcatgagaaattgccaaactgttttacagagtggcagtcatttcacgttcctaccagcacccttgaacgccagaattcctggtatcctcggctgaactggctattgtcggtatttttaattttagccattctagtgagtatctcatcatggttttgcttttccctgacagctaatgaggtggattgagcatctttttgtgtgaaaacctcatatcttttaattttcctcctataacctgcataagtatgaggaagaaaagtgtgaactgaatcataactaaaggaaagaagaacattgctgtcttaagcagatcacgcctttgtcgttatacagtatggtacaataatccattacacatctctttgattcatcttgtctgttaaatttctttataaaatttgtttagttgatgacacacctgactctaatataagagttgaatgttgtatcacttttttttttcctttttctgagacagagtctccctctgtcacccaagctggagtgcagtggttccatcttggcttactgcagtctccacctcctgggctcaagtgatcctcccacctcatcctcctcaatagctgggactacaggcgtgagccaccatgcctagctacttttttttttttttgagacggagtcttgctctgtcgcccacactggagtgcagtggcgtgatcttggctcactgcaaccttcgcctcccgggttcaagcagttcttctacctcagcctcccaagtagctgggattacaggcatgcgccactgctgcccggctaatttttgtatttttagtggagacggggtttcgccatgttggccaggctggtctcgaactcctgacctcatgtgatccacctgccttggcttcccaaagtcttgggattgcaggcgtgagccactgcgcttggcctctatataagcttttaatgaataataaagactctaaattatgcttatttactaccaaataatctttttaaatgaaaaatttgttatccctcccagccctcagccatgacccgaagtatgaaataggcatatctttttgctgctattaggctgtagttcatactggtttagtattgctgttgatcacttttagggacatttaatgatattttatactagatcttgagcaccagctatttattttctcttgaagcagtggtttatagtaatacattgtgctcagttcttttttggttctttgtcaagttcaacacagtagcttctgttgattgagttcttgtagttatgaggggaaattaatgctggtgaccagtatttgagaattaaaaacctctgttcagaaaggcaatgcagagtagaataatgaacggatactataaatgacatatcttgacactgggggtttagtataaataaacagtatttcaatctctggaaattgtaaagcccgttatttaacctaaaaacgttaatggctcagaaaacagaattacatggcatttccttgctaacctcccagagcctatcccctccaaagatgatagggctaaagcctggtccactaagttgttgtcagtcgtacgggctttagagtatgttgacttgatcaaacatttactgtttacaaatatttgcttctagctcatatcctgacacttaaagccacgtgatcttgtagaagtcacttagctgatgaggtaaaactgagtctgtttctccatctgttgaatgaggctggtgatagactctttctttgctctctcccaggtgggtaggagatcaggatgagctgatgtctgtgaaagaactttggatactataaagtgctttaggaatgtatggggttattattttatgaaattgttgattcgtcttcataatttgagatacaagatctccattccattgctaatgcttatggaagattttgtcactttcttaaaaaatattgccaaggccgggcacagtggctcacacctataatcccagcactttgggaggctgaggcgggaggatcacttgagcccaggagtttgagaccagcctgggcaacatggcaagactccatctctacaaaaattgaaaaaaaaataaattatccaggtgtggtggtgcacgcctgtgttcccagctacttgggaggttaaagaggaaagatcacttcagcccaggaggttgaggctgcattgagccatgattgtgccacggcactccagcctggacaacagagaccctgactcaagaaaaaaaaaatacatatatatatatatatatatatatatatatatatatatatatatccaagtataagtatatacttagaggtgggctggtaaaggctttttcattatggatttttcagtttatttcttctaagttttgtcagttgaacagtagggataaattaaagaggaggaaaaaaaatccccatcatccttccttccctccttccctccttcccttcctccctccctccctccctccctccctccctccctccctccctccctcctttcctcactccctttcttttttgacagagtctcactgtgttgcccaggctagagtgcagtggcgtgatcttggcttactgcaacctccccatcctgggttcaaatgattctcaggccttggcctcctgaatagctgggattacagacatgagcacctgacctaacatggttctttttcttttttctttttctttcttttttttttttttttttttgagacagagtctcactctgttgcccaggctggagtgcaatggcacaatctcggctcactgcaacctctgcctcctgggttcaagtgattcttctgcctcagcctcccgagtagctgggattacaggtgctcgccaccatgcctggctaatttttatatttttattagacacagggtttcaccatgttagtcaggctggtctcgaactcctgacctcaggtgatctgcccctcagcctcccaaagtgctgggattccaggtgtgagccaccacgcccggcctacatggctctttttctattcagcttttttggtaggattgaggtagttgtagaggagtgttgataggatagtgaagaaattttaacctttgctaaaaacatgcaagacagtgtcataatgtttaagaatacataaatgttatcattttgtacatgtccttttgaaacttgttttttttattcagcttttttttttttttttttttttttttttttgagatggagtctcactctgttgcccaggctggagtacagtggcgcgatctcggctcactgcaacctctgcctccccggttcaagtgattcttctgcctcaacctcccgagtagctgggactacaggcacgtgccacgacacccagctaaatttttgtatttttagtagagacagcatctcaccatgctggccaggctagtcttgaactcctgacctcaggtgatccacctgccttggcctcccaaagtgctgggattacaggcatgaaccaccgcgcctggccaaacctactatttttaatgggaaggggtttattatagatattatatagctaacagttatggggagggctgaaaaagcaggttcttggttgggcttcatgagtgattcccagatggaacggcctcatagacctgggccactgaggaagctgcagcctcttcaggaattgggaaggtgtcagctgtagaatctgccacaatcaaagccttactgctcctggctccagagccaggtatggtcagccagcaaaattgatatcctgcactctgctcctcaacacccatgaagccagtgcctggacacaggactgctcgtcctgcctcagaaaaccaaatgctttccagccgggcttgcccacagcaacggcagaagcaacagatgtgtgctgggcctcccatctgctttccaaatctcatgtaattgtatccaacttgcagaccctaaatcacatttaaactgtaggtgcaggggaggtggtgatgtgtctgttagattttcagcctccgcactattagaaaagaagggaccctggaaggaggatggaatggctatggattatccatccaccatattcgctccaaattcttaacctgatatgaagatgtatgggtataatgtagggatgctttggaccctgtaattttatgcacacttgggaatgtgcaccagaacatttttctttcattagattctcaaaggggacgatgacccgacagaggctaagcaccattaaccagataagttaagtgatgaagtgcccagattctgaaggcaggcaggcctagatgtgaatcctgtctctgcttcatagctgttgtgagatcttgggcatgttatttcacttctgtaacccttaactttctcatctttaagatagggttctgaggatacttttatggaggtttcatggtaccagcatcctactgggaactgtaactcctgctgcctaccaaatatctataatatctttggcttggcactcaaggtcttctctgaagtagcccaaacatgctttcttgccctactgcagggttgctatgagggtgaagtatagaatgcctctatggtgaatgcctggtatagtgcctggccccaaaaagcaaccaataagtagtcttctcttcccaaagctagtcactgcatgtatgtatgtattcattcattcctcagaagaacatggccaacatgaaaattagggtgtgctgctgccatctctgttaagaataccccttggtggctgggtgcagtggctcattcctgtaatcccagcactttgggaggctgaggcggacagatcactggaggccaggagtttgagaccagccatggccaacatatgaaaccccgtccctactaaaaatacaaaaaatagctgaacgtggtggcgaacacctgtaatcccagctactagggaggctgagactggagaatcacttgaacccgcgaggcggaggttgcagtgagccaagatcgcgccattgcactccagcctgggttacaaagcgagacttcgtctcaaaaaaaaaaaaaaagggctgggcgcagtggctcacgcctgtagtcccagcactttgggaggctgaggcgggtggatcacgaggtcaggagatcgagaccatcctggctaacacggtgaaaccccgtctctaccaaaaatacaaaaaaattagctgggcatggtggctggcacctgtagtcccagctactcgggaggctgaggcaggagaatggcgtgaacccgggaggcagagcttgcagtgagccaagatcgcgccactgcactccagcctgggcgacagagcggactccatctcaaaaaaaaagaacacccttggtagctcctacttgtgctgcagaggtgaacttggctatcacttcctctgttcccactgcatgctgtgctattgctgtgctgtttatcacagtggtgtttactgtcttatacttgcctctctctcatctcttctttttttttcttttctttttttttttttttttttttgagatggagtctcactctgttgctcaggctggagtgcagtggtgcaatcttggctcactgcaacctctgtctcctaggttcaagcaattctcctgcctcagcctcccgagtagctgggattacaggcatgtgccaccacaaccggccaatttttgtatttttagtagagacgggtttttaccatgttggccaggctggtctcgaattcctgacctcaagttatccacccacttcagcctcccagagtgctgggattacaggcgtgagccaccatgccaggcctcatctcctcttaaatgtctttagagcaaagattgtgtcataaccccggcacctagtatcatgcctattacatagtagattttcaataaatgttaaatgcatgaatgaataatgagtaaagaaactgggtaatgtttttagcttggaggagagaagcctaagggaagatgtgtttgctgttttgaaaatatttattgtcgctgggcgcggtggctcacgcctgtaatcccagcactttgggaggctgaggcgggtgtatcacctgggtcaggagttcgagaccagtctggccaacatggtgaaaccccgtctctactaaaatataaaaaaaattagctgggggtagtggcgttgcctataatctcagctacttgggaggctgaggcaggagaatcgcttgaacccaggaggcggaggttgcagtgagccaagattgcaccactgcactccagtctgggcaacaagagtgggactctgtctcagaaaaaaaaaaaaaagagagaccaggcgtggtggctcacgcctgtaatcccagcactttgggaggccgaggcgggtggattacgaggtcaggagatcgagaccatcctggctaacatggtgaaaccccgtctctactaaaaatacaaaaaattagccaggcgtggtggcgggcacctgtagtcccagctactcgggaggctgaggcaggagaatggcgtgaacctgggaggcggagcttgcagtgagccgagatcgtgccactgcactccagcctgggcgacagagcgagactccgtctcaaaaaaaaaaaaaaaaaaaaaaatttactatcatgtaaaggggagttggtctcaccctacactgctttggaaggcacaattaggagctgcggatggaagtcacaaaataaggcacatttggactcagtatgaaaagagctttcagataatgagagcaatcaagtaatggggggggcttggaagccagtgattattggtcattggaggtattaaaggagaggcaagataggaagatatagatggggtttgaataccgtgcggggcttctcagcactcttccttttctgagtgcttttaacaagcggactagggaatagatagggcctctgctctcagggagattattgtctgctcagggagagaagatatattcaggtgggaaagggcaaagggtgttaggaatggcttggctaggatagtcagaggagtacgtggagtaaggcaggaaagcatgtttgggcttcctcaaagatgaccttgagtaccaagccaaagattttggagatatttggtggacattgggcattatacatacccagtaagatattagcaccatgaaagctccacaaaagtgtcctgagcgcctagaacagtacttggcacatggtagatcttcaataaatagttgttgaaggaatttgttaaaatatcagagctatgatttaagaaaattattctgtaatctgaatttaggttgggagtggaaaggagtacccttaagtaggacatgagaagagcctgaagaaaggcagaggacaccagtaggcatcttggatgtgggattggtcagaggggagagaggtaaaaatgattccatgactgtgagtctggcgactagaaatgggggtgacattcacagagtagggtggttccctgtagttcctccttgtgcagaaggtgaggctttgcttgtcgacctgcttcagtagtagcattgacagaacagtctctgtgtactctgtcccctcagtgctttctgcatatgtgttgctcactcatcactatctgcatgttcgtggtctctggaaagaatcaactataatgatcagaataattgcctggtaggacgtatttcctttgagttcagcaagacgtgccccctcacatggtgttcctgttcattcataaggctgtaataatgtatgagttaggagacccttttgaccaattcccctctgttttccatcttggaaaaaccagaactctgttttcttgagcaaatgacgttgccaccagccctgaagctccttttcctgggtttgtaggggttggtggaatcctggcagtctgccgctcttcctggcctccagagatcagggctgtgactttccatctgcagatggcagttctagctgcgaggttggtggccgaggaggacgaggacacagctcagggcctgtccttcaagggcttccgtgtgcagcagcagcactctgtaatatcatagatgaatttttgtcaaaacacagagaaaagttgattacacttctcatttattaaaaaaaaatgacttgatagcatagtagatggccccttatgtaagccacttagtattatttcaaaggaagcatgtctgtgagaaaaggggcaaccacttttctcatagagaagaacaggtttttaaatgaaaagatcaacaaatccaaatgctgtggtatttatactgatttagaaaggcagttgactttgggaggctttgttttctcatttcccttttctccttgacatttgacagacgtggttagcagagagctttctcattcggttttcctggagagagctctgcctcttgggcttcctgcatttgtatggaagttttaattttttttttttttgtcaaatgaaaggttgccatttcatttgttcagatttcccacacactgttgcagcaatctttagatttcaaattggctaattcagtgggtcacttaattcttaacttttacaacattttgagtctaaatacagcaaaattggtgcctttttcagctatttttcggcgttgctatattccaagccactgagctctgttttactctgacattttctcttcacttttgggattctgctcactgtgtttaaggcagctcgatagcattttgccaaaaaagagaagttagggctagtgtgagttgaggggaaggggatgtttctgttgttgctccttgctgagtatcttcagatatctaaaagaaacttgtaacacagcgtcagcctgacactggcctttgcagcatcagccttggttgactgtgttctaatagggatgcctgatctgtatcctctttaacttggctataagaaggttttggagaatgtatgtctgagggtgttttaaaagaaaatggaaacaaagctcctttttgccttgagctcatggtttggaatttgggcatttggaatccttcaagccctcctcctgggcagagctggagtccccttagggcactgcctgtcatcttcactacacagctgtgctccagagcagggagccgatggaaagggggacccagaacattccattctgcagaattcccttccagccgtctgtgagaaggcagtttgggacccttttagaagtttgctttataagtgaagaacctgaggccggctgtgttcatattctcagaacttggtgagaatgaggtactttaagataggctctaagatcagcagcatcagcccactcgggaagagctcctctgactcctggaggagaaagccagatgggggaagcattaagtcctgttttcctattgaaaactgaaattggccagccacagtggctcatgtctgtaatcccagccctttgggaggccaaggtgggaggattgtttgagcctaggagttcaagaccagcctgagcaacacgatgaaacctggtccctgtaaaaaatacaaaaattagctggggcatggtagcgcatgcttgtagtcccagctactagggaggctgaggtgggaggaccgcttgggcctgggaagcagaggttgcagtgaactaaggttgaaccactgtactccaggccttttttttttttttttttttgagacagagtcttgctctgtcacccaggctggagtgtagtggtgcgatctcagctcactgcaacctccgcctcctgggttcaagtgattcttctgcctcagcctcccgagtagctgggactacaggcacccaccaccacgcccggctaattttttttgtattttgttatagagatggggtttcactgtgttagccaggctagtctcgatctcctgaccttgtgatttacccgcctcggcctcccaaagtgctgggattacaggcatgagccactgcgcccggccaggcattttttttatgtgtgtctcaaataaaaagaaagaaaaccaaaattttacctgaaagacgagaaagttgatgaagattttgagaaagtgaggaagcaatggcccctccagggcacacccaggtgctgtcccttcttttctcctcagttctcttagctataaaatggggcttataataatcccttccttgaagagatgttgttaatagtacttagatgatttgctaacttatatcaagcacttactctgacccaggtatcggactgggtgcttgacatatattatctctattgtgttttgcagagtggctaagattttttttttttttcttttttgagacagagtctcgctctgtcacccaagttggagtgcagtggtgcgatcttggctcactgcaacctccacctcctgggttcaagccattttcctgcctcagcctcccgagtagctgggattacaggcgtgtactaccacgtctggctaatttttgtatttcagtagagatggggtttcaccgtgttggccaggctgctctcggaactcctgactccggtgatccacccgccttggcctcccaaagtgctgggattacaggcatgagccaccagagacggagtctcactctgttgctcaggctggaatgcagtggcgcagtctcgactcactgtaacctccgcctcctgggttcaagcaattctcctgcctcagcctcccaagtagctgagattacaggcgtgcgccaccaagcccagataattttcatatttttagtagagacggggttttgccatgttggccaggctggtcttgaactcatgacctcaagtgatccatccacctcggcctcccaaagtgctgggattacaggtgtgagccaccgcatccggccccaatttattcaactttggaagcgttggttgtgagatgtgcagttgggtgttgtcatggagaagaattgggcccttcctgttgaccagtgccggctgcaggcattgcagttttcggtgcatctcatcgatttgctgagcatacttctcagatgtgatggtttcgccgggattcagaaggctgtagtggatcacacaggcagcagaccaccaagctgtgaccatgacctttttttggtgctagtttggctttgggaagtgctttggaacctctttcggtccgaacactgagctggtcattgctgtttgtcgtataaaatccactttttgtcgcacatcacaatctgatcaagaaatggtttgttgttgcgtagaggaagagaagacgacacttaaacatgattttttaaaaatttttgctgatgtgggacccgcttaacttcccaatttgcttcaaatgccaaatgatcatagaatggtcaacattgagtttttcagcaacttcttttatggttgtaagaggatcagcttctgtgattgatctcccaactggtcgttgtcaacttctgatggccggtcattgcactcctcatcttcaaggctctcgtctcctttgtaaaacttcttgaaccaccactgcactgtacgtttcattagcagctccttggccaaatgcgttgttgatgttgcgagttgtctccagtgctttacaatccattttgaccttgaataagaaaattgctcgaatttgctttttgtctaacatcattttcacagtctaaagtaaacataaacagcaaggaataagtcattagcaaaaaaatgtaaagtgagaaatgcccattaaaataatgtataacataaccacatttatttaagaatgtactcgaatatcaaatgacaaattccaacagtgtaaaaactgtgattccttttgcaccaacctcatactagccaggcatctttctactgaaactggctggagaccatgtctcagtggtggagccggtataggaggcttcacatttcttcccctaggacacgctgtcattgtttaggtttcttgttttgttttttcctgaaacagggtctcactctgttgctcaggctggagtgcagtggcacagttacagctcactgcagctctaacctcttaggctcaagtgattgtcccatctcagcctctcaactagctgggactacgtgcttgtgccacacatttaggtaatttaattttttttttttttttttttttttttggagacggggtcccactacgttgtccaggctggcctctaactcctgggcttaggcaatcctcccacttcagcctcctaaactgctgggattacaggcatgagccaccacacccagccagttgtttagttttaaagatttaacctggttgaaatgtggctagtccccttatgcttgggtcacagaccaatttgggttaactttgccattgccttgcctgcagatcatggtgctgttgggatgtcattttgctgtaccaagggtaaacagtagctccctccttaacatcagtcctttagtgtaggacttctctattaagagctgggacactgttggccattaggattcctgttccttttgggtttgtaatagaagctactgtccccctgatcattactgattgaaacaagaaatctgttgttcctggatttctttcagttatcttaacatagacccttccaagtcttacagatgtcaagggtttttgaaagtaggatgtattctgatctttttcaagtggctacatcactgaccctcataaaataacggaaaatattgggagatgacttttctgcttaaatgttaggaaactaaattctcagtatactgcttctctagttgttaaggaagaaaatttctcttgtaaactttttgggagactagatttatttcctcccccactttttttttttttgaaatggagtctcgctctgtcgccaggctggagtgcagtggcgcgatctcggctcactgcaacctccacctcccaggttcaagagattctcctgcctcagcctcccgagtagctgggactacaggcacgggccacaacacccagctaatttttgcattattttttggtagagacggggtttcaccatgttggccaggatggtctcaatctcttgacctcgtggtcagcccccgcaaagtgctatttcctcccccgcccctgcttttttttttttttttttttttgagacggagtctcgctctttcgcccaggctggagtgcagtggtgcaatctcggctcactgcaagctccgcctcccaggttcacaccattctcctgcctcagcctcccgagtagctgggactacaggcgcccaccaccacggctggctactaatattttgttttcggtatgtttttgtatttttagtagagacagggtttcactgtgttacccaggatggtctcgatctcctgacctcgtgatccacccgccttggcctcccaaagtgctgggattacaggcgtgagccactgcgcccggcctatttcctcccctttttatgaccattcacagcctttggcataccattaaaatctgatcattgacttctaggtgggagaatggcatctctcttttctcctcatgataaggacttagtctgtaaaccttccagtccctccctaccctgaagcctcccatggtcttttctctctcccttgtgaaggaaaggtccctcttttaaagcattattcagaccggaaggaggacaaaatcaagacatgctgaaaaacccctgttttaatcaactccccttttaattttttcaaaagtcattattaggcatcgaaagctgttgaccttcatcaaacaatgagcacaggatttcttttccgcatcacgcgtggtgccactccagtgctatggtgtgatcagaacacccacattaataagaacattacttctctgaagtaatttgaatcttcatttagtaagactaaccatttcttcaaattttgttttttagtatacaggaaagttacaggttttttttctcttttatttgacaaatgaaagtgattttatattcatcacattacaaaataaataaatgctcattatttaataagaaaattcacatctgggctcagtggctcacacctgtaatcccagcactttgggaggccgaggcgggtggatcacctgaggtcgggagttagagaccagcctgacgaacgtggggaaacccccgtctctactaaaaatacaaaattagctgggcttgctggcgcgtgcctgtaatcccagctacttgggaggctgaggcaggagaatcacttgaacctgggaggcgaagtttgtggggacccaagatcacgccattgcacttctgcctgggcaacaagagcgaaactcccagctcaaaaaaaaaaaaaaattcacaagtacagaaagagatgctgaagaaggtaacagttacctagaaccccacccccagagataaccaccttgtggtaacatttatttctctgccgtagccactcttgtctgaaggagggttcatagtagataggctgtttttgttcatttgcctttaaaaatatatatattgtaaatattcttctgtgccattgaatataaaacatggtaatttttaaatttgtgtggtgtgcatgtgtgtgcacttttgggaaacttgtttatagtgactttcaaactgagcatttacaaagaaattaacagttgttgggtgtgttgaatgtgcagggttttgctgaacactttacaggggtgtctgatcgagtccatcacttcctgtgggcttgtgcaatagcctccttactgatactcctgctttcagtcttcctcctctgctagttatttttcatatgaaaacctgaataatctggctgggcgtggtggctcacacctgtaatcccagcactttgggaggctgaggcaggtggatcacaaagtcaggagatcgagaccatcctggctaacacggtgaaaccccttctctactaaaaatacaaaaaattggccgggtgtggtagcgggtgcctgtagtcccagctactcgggaggctgaggcaggagagtggcatgaacccgggaggtgcagctttcagtgagccaagatggcgccactgcactccagcctggtgacagagcgagactccgtctcaaaaaaaaaaaaaaaaagaaaaggaaacctgaatagtctttcaggaatgcaaatgagatcatgttgctcctctgcttaaaacctaatagcttctccttccatgtcacaaaaaaagccaagcatataaccaagatctggcctaggtcccagcatcgcttcatgtatcattggcccatctttctgtttcttcagtatgacatttgtttcagcctcagggcctttgcacttctttctggttcccctgccctgggacatttggataattgctttttttttttttcatttcaggttctagttcaaattgaatccaagtgaagtgaccccataatacatgttaattgtggaaaaaaatttaaatttagcaaagtaaagaatagagcatgtcactctaccatccactcaacatttttgtggttttttttcatttaattaattccatttattcattctcttaacacaatgcctacaatatgccaggtatattatattggtgttaggttgggctataatattaaaaaggacagtcatggttcttgcccttgaggtctgttagatcaggaattcagaagtgggttagctgagtggttctagcttgtggtctctcatgagattgtagacaagatttcagctgggacttcagagtcatttgaaggcttaactggggctggcaggcctgcctccaagatggctcactcacagggctggcgagcagtgctggcagttgacaggaggccacagttccttgccacacggacctctccacatgcttcttgcgtgtcctcacaacatgtcagcagctttccccagagcaagtaatccaagagatcacaaggcagaagtgacatgtctttataatcacagatgctaccctgctgttctgcagtatcctgttggttccccagtctaccctattcagtgagggagggcactcactcagcaaatgtgccgggaatcagtgggggcattttggaggcttgccactcgctgcctgtaaaatgagcatcataatggcacgtgtaccgctaccaccccctgccagcacaaggggaacatgaacctaacataatgggggcagggaacgggcagaagaggcttcccagaggagacacttaggcagagactgggccgctgagtgggcgtttgggaggtgagggtgttccaggctgaggggaggtttgtaggaaggtcctgagtgggaaggcactgcctgcagtagcgcatggcctggaggagacagcaaggcgggccagggtcagagaggccaggacacacacatcactgtgtccttgagggagatctttcttctctaggaatatagctgagcttaccccagaaaccaggggagaaaataggagccgagttttctggagtgcgtttcttctgtgaagtgaggtttgtgtgtaggaggcatctgtccagagcttttcaagttttatttcattattgctggagggaactagctctggtcctgttggttgggactgaactgtattgctgaccctttcccatgttcaaagttcccgcttccattgggggactgtgctttgtgcttcttcttgtaacaatgtgtttagcttatttagcagcatcagattctccttctgatatatgcattcgataaacctggacacctgtgcagatttctttttcgtggtggcactgtgttttcttttgcttgttatgcgtaaggtcagatatgttgtgttttgggtccctgacaccttgggcttggatgaataatgtcacttaagaggaggcaagtaaaaggccaggcacagtggctcatgcctgtaatcccagcactttgggaggccagggcaggtggatcacgaggtcaggagttcgagatcagcctggctaacatggtgaaaccctgtctctactaaaaatacaaaaattagctgggcgtggtggcgcatgcctgtaatcccagctaattgggaggctgaggtgggagaatcacttgaacctgggaggtggaggttgcagtgagccaagattgtgccactgtactccagtctgggtgacagagcaagactgtctcaaaaaaaaaaaaaaagaggatacaagggatacaagtagaatttgtagtgtgctgattaaccaaagacaagttcctccacccttttctttttggccagagttgatcattttcagaattcatcattttgtcaagatgatttttttgttgttaaatatgaataatttgctttcctctggacttctaaggcttcctgaaattacatgcaaacatttgtgcagtctcatgtttggttattggtttttgggtttgctatttttgggcgaggaggtccatatccttcatcagcttctcaaggggttttttcagaggtacaaggggaggctttggtttggttatgacagtgctacagccagcaacccgggggccacctgggtgctgctcccccacttcaaaacgtgtagctagcaggatggaaatcctgtctacatggaaatccttgtggtgttggataggccatgattcatttccctaagcctcaaatgcttctattgtttgtagtttttctcccagaatcttcatgatccatttttgtacattcttatggccttacgataaattcctagaagtggaatttctacatcaaaagaatagaaacttttaaaggtttttgatacatattgccagttgcccttctggaaggtctactgggtacgtcagtgtacctgagtgttaacagtgacggatcagtattcatttctcttataaggaaggaaatgaaagtcatttggtaacgtagaggcacaattagacctgacagcctttgtgtttctcttctgttctttaggccccccagttccctttgctgctttcttctttatgccacagatttaatgcttgaacacatattgaaattttggaaagttactgtgaatctaatggggcataataggcaggttttcttaatcctggcaatgaccaaactaatcacttgtctgtggtggcttggtggaaaaacggtttgtcagcagaatttggtaaagaagcagtcacaaggacagggtgttggtctcatatttgagtgcttccctgaggaaagaaaagataaagggaagaattgggtgaattcatcagactgtatttggcagatggagatgaagtgggtgcaggtcatcgcccacgacctgtttcccaggcttgcagagaaactgctgctcaggagcttgtgactgtgagggccccgggccgtggcatgcgttggtgcgctctcaagaatgcggccatggcactcacagacacataccaagaagcctcggcccccagtgcccccgccagcctgctcaggggcatgcggatgactggagcctggaaggcgggtcttgctgggcaggacagatgccttactgtcaggacagatgccttactgtaggcccaggaagagatccatgaccgcagacagacttctgcgtagggccctgaggaaagagtggtaaacatgcagtgaagggcggccccaccactggtggcttctgacagggagctggagggtgcaggtactggatgtgtctcattgggatacaaatgagtgtgccccgtggttaggaagatgaggaagtgtaggcacttgcaggggccttttcttttgacttagtgagttcccaccaaacctggccttgtctgtttttgatgccttaggacttggggacaaggccacagcctgtgaccccagcatcatctccccccagggccttgccaccctctagctttcatccttgcctcctcctctgccctctctttcttgtccgatacagtcacaagtgcctagaataaacctcacaccacccactgctctgctgtcagggctaccaccccggccccaccctgccttgccccggctctgatctcaaagacttcccagcctcctgttgccatctgggtctgtcctcctcctgctagcagagagaccctcccttagaaacttacatcagatcttttcactacccagtttcctgtccctcgatgggtacccatctcagttagagtaatgttcagcttctctccacagcctgcgtggtctgggcctggtttccctctcgaatttccctcctgtcactccctttgtttactgccagtgctttttcctcttagggttccctgggccctgcccttcactcagcttctggtgcctggctctttcagacccatgcaggccccagctcacatgacatcttttcggaaagaccttccctgatggcccaggccacagtacccacaccagcatcagctctttgtcctcttccccttttcatttctttgcagctcatgccatctgaaactacctcattcaattattgatagatctgtttggaattccaggagtccctttgcgatcccattcttctaaagattcacatggcctcagaatgccatgttacagtggagagtctgacttcttgttttctgagacggagtctcactctgttgtccaggctggactgcagtgacaatctctgctcactataacctccgcctcccgggttcaagcgattcttgtgcctcagcctcccgagtagctggaattacaggtgcctgccaccacgtctggctaatttttgtatttttagtagagatggggtttcaacatgttagccaggctggtctcgaactcctgacctcaggtgatccacccgcctgggccctccaaagtgctgggattacaggcaggagccactgtgcccggcctgacctcatatttgaataccgagttttagttctggaggagctgcaggttttatgaaaagggaacacatttgattcctcagagcagccacaggccagctctctgaagtaaagtgcacgtgtgcatgtgtgtgcacactcacacacacgtacacacacattcacaaataggacatctcttttaaacagaaatggccacctgcatttgagaaaataaagtttcatgcagaagaaagtgacatgttaaattcaatcatcaagatttagactggtgggaattctgcacaacaaatgacttggtttaattaacatggaaattgcgaggaaaaaaatgaagtggaacctatggatttaaaaattaggaaattttaagatttccatcgtaatttttttaaaacaatatattttacttccaaaaccctgcgttttcacatggtagctatctgctggagctgagtagccgctgctctcttgaacagcatcacccagatgggagagcccccttccccccaacccccatacactcctatgtgtacaacttcctgaaccctgtaagcattagagcttgcagcctctgctttttctgtttccttcttgatgggaagactggcagcaggatttacttggttgctacatttgtgaatttgtaaaataattcatgctctgctaggtctgtaacttgggaggcttggtgtgcacgggcatttagcagcaactcagagcgtatggaagactgtcactggcaagagcaaagtccccccaggacagagccagtgacgactagctgtgtatcctcagtctgatggcggtggaagtgaggcagcaccaaggagcagaaacaggaagtttccactgatgaccaccctgcccccagctaggctgaaaggcctccccagagcccttgcatcagcctggctttgcactggtctgggggatgttgcttgttagagccagtgaagaagaacggtagtaagttacctgatggccaaggctctgtctgaccctgtctgctgtcgtgttcctggcacagaatagtctttgttgaaggaacgaattagtgcatccttccaagccttggaggacctgtctataataggcccactctatagggtctttgtgagaattaaattaaaacccctatgagaaacctaactagagacaattggaagtaacttaaatatttgttcattgggaacagctacataattgtggctgtcattctgtacaacactctgtggctgttaaagagctagaggtagttttatgtggattgatgtgttcaatgtgttcaatggaaaagcaagggtaatataatcccatttatactacagagaaaaatcgggtctgtaaatatgttgagaaaggtctgtcgatagtggttatcttttgagagtggaatggatcggggtgggtatggcctggggacgtgagggggaatttttcactctttatttcacatacatctgtcattggcacagaaaattaagcagtaaacctaaagaaacagaatagtgcttgttgtatagttagatcaataacttgtaactattataaaaggtagttataaagttagtaagggccaaaggtctaactagagtaggtcggttatagaggaaaacagtttaatcagttgttgtttaacttttatggaatgcaacttctttagctttaatttggagagccaaactatggccctagtcttttttttttttttttttttttgagttggagtttcgctcttgtccaggctggagtgcaatggtgctatcttggcttactacagcctccacctcccgggttcaagcgattctcctgcctcagcctgccaggtagctgggattacaggtgtgcaccaccatgactggctaattttgtatatatatattttaagtacaaatggggtttcaccgtgttggccaggctggtctcaaactcctgacctcaggtgatctacccaccttggcctcccaaggtgctgggattacaggtgtgagccaccgtccccggcccctagtcttttattgtattgtattgtattattttttagtcaggtttattgaggtataatttacatatcataatattccccttctttattatacagttctatggactttgacaaatacatacacttgtgaaattgccaccccttttgagatacagaacagttctatcaccccctagaattcccttgtgcggcccttttgtagtcatcctttctctcttctcccagctgctggcaaccctgatctgtttttttgtccctgtagttttgccttttccagaatgtcatatcaatggaatagtacagtctgaagcctttgaatctggcttctttcattcaatataatgggtgaggagtcaaccacgttgttgcatgttatccacatttcctccttttgtgtctctgagtagtattctcttgcatagatgtaccacagtttgtttatccattcaccagctgaaggacagtgctccagggtcctagagcacagaactctggctttgttgtctttatttctaccagttgtctctctctctgtctctctctctctcttttttttttaaaccctagaagattattaagatttataagactgggtatggtggctcatgccagtaatcccaatgctttgagaggccaaggcgggaggatcacttgaagccgggagttcaagaccagcttgggcaatgtagcaagaccccatctctacaaaaaattgaaaaattagccgggtgtggtggtgcacacctgtagtcccagctactcaagaggctgaggcaggaggatcacctgagcccaggagtttgaggtgatagtgagctatgactgcaccactgcactccagcctgggccacagcataagcacttgtctccaaaaatgtttaaaagattgacaatacagtcttcttcagagtctccataggaaaggagcggcacgaaatgcaaattatttggaggttttggaggtttcaaacttttaattacttggcacatatagtgcttactgtgtgcaggcactgttctaaatattgctttcaaatatttaaaagtgcttagaacagttacagcacatagtaaatgctatatatctgcttgttaaataaataaaaatttaagtttccaaataatctgtatttcacataaaagagaagagatgtgggacaatataaataggcaggagaccagggttgtagacccggtactatcacattcccagcctaccccttaacctagtcccttgggtgaattaccgactctgggtctcacttactaacatgaaaggaggttcataatctgaatcctcctgaaggaacagataatatctcaactcttaatagttgaactctaaaatttggtcagtataaaagtaatgttataaaatgtgtctatatctgtttattttacattgtattgggcctggataattggtttcttcctttttacatgtatataacatcctattgggatctgtattaaaagtgtactaaaaacattcaccacatggtggtgctcccttcaaaagccaaactgaaaattgtaggccagcattgagtattaggcatggagttgataggggcagctgtatgtatgtatgtatgtgtgtgtgtgtatgtatgtatgtatgtatgtatgtagagatggggcctcactatgttgcccaggctggtcttgaactcttggcctcaagtgatcttcccacctcagccttctaagtagagtgccagtttatattctacatttgtgctttaagttttttttagggaagtagggtcctgtcattttattagcttgataacttatacagatgccaaaatacaggaacatttgttctttcttaggcattatgacatattcatgtacattaactgatgttatactttttaagtgttccaaatatcttcactcagaagtttatgtgcttgacaggaaaagaaaaaatacatctgtaaggaaagtatcataggtatttatccttcaaaagctgatgtttttatttatttatttatttttaacctaatgtgttcttaagtcatactgggatagcagcagtacccagcctaagagaagctgcagtatagtttccttggtcaaatgactttttctttctttctttctttctttttttttttttttttttgagacagagtcttactctgtcgcccaggctggagtgcagtggcagaatcttggctcactgcaacctcctcctcctgggctcaagcaatcctcccacctcagcctcctgagtagctggggctacaggcacgtgccaccacgcccagctaagttttgtattttcagtagagatggggtttcgccatgttgaccaggctggtctcaaactcctggcctcaggtgagccgccagccttggcctcccaaagtgctgggattacaggcatgagccactgcgcccagccaaaagttggtgtttttaaaaaatgcttcctggtaactgccttagggagaataatgttaacatttcagttgtgattctcttgaagcacagtatttccctgccttttagatttgaaatggatacttctaagcagttgtgactggctggatttcagtcatttacatcggaacactggtctggtcagctcacctgcatctttggtagagagatatctcccaaacatacactctccctgaaggattttcatccttcatatgcttatcaattcccttgccaagtatttactgtttgtccacatgagtacaaggcattgagcttgtgctactgtagactcacagatggtcatgattttcaggaattgaatagagaagatgaaacactgagacactggattcaaatgctagaccttactgggttgacgttagtaatagacatgtgaagaattatagcggttgagaggaaagagacatctcctcactagggtgactggtcagggaaaaagatgggagtggtttttggtgggagaagaggaggagacgggatctgggcatatgaagaggcctggggtactgaggtggaatttcaccacaccccaaatctgttgaaaagaggaaagtgtacaggcaggagacacagaatctggccagagtgaatgtcctgagcaagggcatgggaagaggaaaacgcagggcacagggattaggtgaggatccaactgaatgcttgcccaaggggcttcactgtcgaggattttgactgagatgggggcaaacatgatagacaaactttagggacaatttagcattgtcttcaaacacaggtatgagggagacttttgctggtgataggacagattatcctgaaaattgacctgacaaaaatacttagacctgatccctaaaatataataaacatctttttaatgaatagctgaacttgcaagaaaaaaggtaaatccccaaggcctataaaataaaagatgagctggccgggtgcagcggctcacacctgtaatcccagcactttgggaggccaaggcgggtggatcacctgaggtcaggagttcaagaccagcctgaccagcatggagaaaccccatctctactgaaaatacaaaattagccgggcatggtggcacatgcctgtaatcctgctactcgggaggctgaagcaggagaatcacttgaacctgggaagtggaggttgcagtgagctgagatcgtgccattgcactccagcctgggcaacaagagtgaaactccatctcgaatttaaaaaaaaatttaaaaaataaataaaaaataaaagatgagctgaaaataagaaagacaagccaaaactgtaaacgtcttggcattgtttgctaatttcagtaatcaagatgcttttttcccccaatgttttgtttttgttgctattgttttgaaatagggtcttgctctatcgtccaggctggagtgtagtggtgcaatcatggctcactgaagccttgacctcctgggctcaagtgatcctcccacctcagcctcctgagtaactgggactataggtgtgggccatcatgcctggctaactcttttttttttttttttttttcattttgtagagatggggttttggggttttaccatgttgcctaggctggtcttaaactcatgggctcaagtgtccttctgtttcagcctcccaaaatgctgggattacagacatgagccattgtgcccggctccccaatagttttattgaggtataactgacataaaataaactgcacatatataaagtatacaatttgataaattatatgtatatgcccacaaaacgatcaccacaattaagatagtgaaaagcccatcatcctcagaagtttccttatgattctttgtaattcttccctgatttacctccttcccggtccaatacttacctgttttctgtcaccataaattagttttcatttatataaaattttagaaaatacagtcatatactatgtactcttctttgcctgacataattatcttgagattcatccatgtttttggatcaataatttgttcctttttattgctgagtactattccattgtgtggatggaccataatttgtttattcatctgctgatgggcatttgtttccctttttgggctaatacaaataaagctgctagaacacatatgaacatatcttttttacttttattttttgcctttttcctgcagtatgagcaaagctttgtgtggacatttgctttcttttcctttgggtaaataggagcaggatcgctggtcatatggtagctgtcgatgacacttgagtcttaagggctgctgtttggggaactggagacataatcttgggcctatgagtagacagggacttggaattcagactgccctataaagctaagatcattgattggctacactttgagcaaaatgatagactagaaagaataagctgttggcagaatatttaaaaaagaaacttgccaggcacggtggctcatgcctgtgattctagcactttggaaggctgaggtgggcggattgcctgagctcaggagttcgtgaccagactgggcaacatggagaaacctcatctgttaaaaaaacaaaaacaaaaagcaaacaaacaaacaaaattagccaggcatggtggcgtgcatctatagtcccagctacttgaggggctgaggctgaagtatctcttgaacccaggaggttgaagccgaagctgagattgcaccactgcactccatcctgggtgacaaagtgagaccctatctcaaaaaagaaagaaagaaaggaagttagaaagtgggggagggagggaaggaggaagtgaggaaggaaagaaaggaaagaaaacaaagagaaagaaacttgtctgatttggtctgcactttgagtgagaggaaacaaaaacctcccgagataacttttattctaagcatgccttcttttaaactttgtttgaatttacctggcctctgtagtttgtgaaattccaagaagagacattattttagagagatactaggttgctagagttcctagattactacagttcctagttagctggcagaagtcaatgcatatcctcttggactatatctatctttttctcagtcttaacaccagattcccaaagataaagcttctccaaacatgatctcacaatccaaaactaagaacatgagaaaacaaacaaccttgcatcacagagcaggaaaatgaacagtagaactatagtactttatagctttagatataaaaactgtcagattcagaatataaaatactggtttaaaaacatttaaagaaataaaatgtgaaatagaaaacaagtaaggactaaaatcctatgaagaaaaatcaaataattgaaaaagaactaaaaaagaaatgaaaactacgatcagtgaaattaaaacttcagtggatgggtttaacaagttagacacaactgaagagagatttagtaaactgagggataaagctgaagaaattatacaaaacgcagcatagagagacagaagtctaaaatataagcctataaggagagagaaaagaagtcaatagagataacagatgagagacaatatttgaggagatattgctaaataatttccaagaatagtgaaaaacaagaatctttagattcaggaatcagagcaaatcccacgtggaattaaaaaaaaaaagtcttctccaaatataaggccaatagaacaccaaagacaaaaataagatcttaaaagcaatcagagagaaactgattacctcccaaggaaccctattaaactcaaaggagacttctctacagcaacgatggaaaccagaaagaagacagtggaacagtatcttaaaagcgctgagagaaaaattattgtcaacctagaattttaaacttagctaaaatataatttagtaatgagagcatgataatgacattttcagataaacaaaaactgatgtctccagcacggtctcacaaaggaacttttatactttcaaaaaagagaaaatgatccaaaaaggaagaatgtctgcaatgcaagaaagaatagtgagggaaaagaaaaagtggaatgaatagagaattagtcatgtggtatcacatggcagctcactcaggaatcataaagctggccttgggataacagagctaaactttagagtcctgagtcctgttaatactcaatcctctgtgaaattcaattaagtgagcttcaagttaacctaaaaagctgtggtgaggctgggcgcggtggctcatgcctgtaatcccagcactttgggaggccgaggcaggcagatcacctgacgtcaggcgttcgagaccagcctggccaacatggcgaaaccccgtctctactaaagatacaaaaattatctgggcgtggtggctacttgggaggctgaggcaggagaatcacctgaacctgggaggcggaggttgcagtgaccagagatcgtgctactgtactctagcctgggcgacaaagtgagactctatctcaaaaaaaaaaaaaagcagcagctgtggtgactcttttcttgaggtctttgggggctgcctgttggtggacaggctggtgtgaagttggtagccctggaggagctggggggagttgcagggctagtgtagacaagctacagaagccacaagggaggtgctgcttagagggggctctttattctttgtttggttttaatttgagacgggttcttcctatgttgcccagcctggtcccaaacccctgggctcaagcgatccttctgtcgcggcctcccagagcgctggggatacaggtgtgagccaccatgcctggcctctttactcttattaatttaatgctggttttcctagatctttgtctttttttctggattttgggagatttctttccttgagtatttttcacttattttctattaattttttattttggcagtcatactttttaactaccacagctcttatttaaaaaatccttctcctagtatcacattcttgatttctgggcatataatctttatgggtctctctgaggatatgagttacggttttttgtagtttggattatctccagtttcctgaattatctgtttccttcaggataatctgttcatcttggtctttttctgtgatgctctaggctttcctcagcagtctggtaatcctggttgtccattcatgcttaagaacatgggaatggaaggggtgttgggagtcctatatatgtggatggggttgtccattggctggtttcagtattggactaatgagtagaggaatcaaggaacctctcagggctttgtgttgggacgctgacacactgcattagtaccttctagactatgagcaggggaatcgaggaacctctcagggctttgtgttgggacactgactcactgcattagtaccttctagactatgagcaggggaatcgaggaacctctcagggctttgtgttgggacgctgacacactgcattggtactttctagactgtgagcaggggaatcgaggaacctctcagggctttgtgttgggacgctgacacactgcattagtactttgtagactgtgagcaggggaatcgaggaacctctcagggctttgtgttgggacgctgacacactgcattagtactttgtagactgtgagcaggggaatcgaggaacctctcagggctttgtgttgggacgctgacacactgcattagtactttctagactgtgagcagaggaatcgaggaacctctcagggctttgtgttgggacactgactcactgcattagtactttctagactgtgagcaggggaatcgaggaacctctcagggctttgtgttgggacactgactcactgcattagtactttctagactgtgagcaggggaatcgaggaacctctcagggctttgtgttgggacgctgacacactgcattagtactttctagactgtgagcaggggaatcgaggaacctctcagggctttgtgttgggacgctgacacactgcattagtactttgtagactgtgagcaggggaatcgaggaacctctcagggctttgtgttgggacgctgacacactgcattagtactttctagactgtgagcagaggaatcgaggaacctctcagggctttgtgttgggacactgactcactgcattagtactttctagactgtgagcaggggaatcgaggaacctctcagggctttgtgttgggacactgactcactgcattagtactttctagactgtgagcaggggaattgaggaacctctcagggctttgtgttgggacactgacacactgcattaatactttccaaactttatgttcttcagagaagacccctccttgctgggggtgaggaggtggagaagtgggtcaggcgtgtgccttggctggctgccgcttcatatacagacgtatgatccctggttttcccccgccctctgtgtctcactcccttcctccactgcacttgccatcttcatgtttggggctcttctgggcagatgggcttgatcctcacctgtgaattcctctgctctcctttgccaagcaatgcttgcccatccactttcagatcccccagtttgttgaaatatctagtatgatgacagcttctctgttctcaccattgtcgtggtttataccttttttactccttggctgtaatttaaaggggtcacaggcaggagggggatgagtgcatgtgctcagtccaccatcttgaccgggagccccagaggcatcatttcaattcctgtgatattatggattcctacgggtaggaaaaacacagcccattcaaccaaatatactttaacccctagagatttagctttaacttgtttagaattgtttaaaagtcccttgtattttgcagttttttcattttctccttgaaagtaaaaacatttgtggcaaatagggaagaaaaactttccagttaatcgagaattaggataagtgagatttaaatattatcagatactgataagaactatggcttttaaagaatgtcgtcttagaatcagtttctaattacttgtgtgcagaagagtcctgcagctgtgaggtgatcacagtctttggcctaagccactgccaggtgagtgaaagccaatctggagtcacagagtggcagcgactgcaccggagatgtgtgtgccatttgttaagatgagtcaaatggtagttagggcaacgaagatccacagagggagaaagaaagatactggaaaagcagcagcacagtttaataacagtcatcgttcatgatggcaaggttgtttactataaaaattccatccttcttgcctctgtgctgccccccaccatttttttatttgacattagggcttgctgatttatggcataacgcagtacatttcacctctgaaacaaagtctgtaaaatcttgagatatattaaagtctttattccccaacgctaaagacctcatactgtttagtcctctatacatttagccctttatgcttggggagggggaggttataaatttctagagggaactggattggcaatggtatgtttgatggtgaaatgccttgactaaacaaacaaggctgctccagaaacgcacacacagcaaacctatatgccatataagtaacgtgttatgtggggagttactttaggtttaaaacaaatgtcatactcttgatgcttttaggtagctattatcttggtaaggataagacagaaatatggtgaagttgcatctgattttgagggatactgcgggcaaacctgacagctagcttggttactagaggtttaattagttacagctgctctgccattgtattaatagagccactctgctttcaggcaccatggatgccttttataatttggatgttcttaaaaagagcactgtgtgaaagtgagcagccctgggccgggcgcggtggctcacgcctgtaatcccagcactttgggaggccgaggtggctggatcacgaggtcaggagttcaagaccagcctggccaagatggtgaaaccccttctctactaaaaactacaaaaaaatactccgggcgcagtggcaggcacccgtaatcccagctactctggaggctgaggcaggagaatcgcttgaacccaggcagcagaggttgcagtgagccaagatcacaccactgcactccagcctgggcgacagagtgagactcagtctcaaaaaagaaattgaacagcccattttgtgaaccacttcaaaaaaaagcaaacacattttcctctggcttttggctgttttaggaagaagccatacggtgaaccaggtgatgctgaggttatctggatccaggccatgcagatgaagccatatttacctttgtgatattggggctgatcttggagctgtctggatctgaccagtctccagatgaaaactcttgcaactttcgtttttggatagtgctcacctcgtatctgtactcgtacctgctatttctaggcgaattgtcccctttctcctccctcttccctcatctccctctctcctctgcctggctgacaccaggaaggaggagttttcttttatttagataaaaaaaagttgagaggagggagctccagaaatgtgggatactcagcactggagacatttgggctggaattcttgtttccattcttttcttaccatatgaccaagtaagtccaagaaagtagataggattctgagtgggcagtgaaggtggaaatgtggtcctaaagagaacgggcaaattaagaaaagattgttttaagacagtcaaattgttttgcctgttgaagaaggtgatcagaccctaatgaaactgaaaatgaggagagtgttcccatctcctgcctggttctagcgactctgcaaatgggtgcctgattggtctgttggctctgaagccagcctttgctggatatattcagcctgttttgaagttgtgcagagaacctcacttgcgtcattctgaagacgcagtgagtcaacgcagtcccaagagagcagtaatggccccaaacagaaacttggaatgaaaaatagccatggatttaaagacatagcacattcttcctatgacttcatttggtaatggtaagattaattcacagaaaacccttcttgagtggcgtaccttaaacacatgtagaatgatttttttctttgcttttcccatttagccttttgaaacaggatacacagtagggtgattggtttgggagggcactggtacagtaattctccacctctcacttgcccgtgtgggtgccccatccccaccctcaggcacacacgcactcttagctgcttttggactcctcccgcaatgtcacaatagttttctttgaacattcttgaccctcagtcatgttgacatgcgtttggattttcagtggagaagaattgccagagaagaatcttcctctgattttaaccattgaccatatttatatatgcagtttcagcttgacttttaaattgataatcttttaatagaattccagataacatcttactgtaacaaacaccaaggggattatccaaattcctatttgaaaatatgtcttttatattaccagatttgccagctgcattattatctattagtgtgtactaaaagtatattattttggcttattttgagattagataattcccagtggaattctccccttaaccatctaaatctgtattttttttttccccatttagtttcctaaacagtgaggcttctgggcaggaaatgagagaagaggaggaggtaatatagaataatgcagtggctttcaagcattgtgacccatatgaggaatacatattcagttatgacttagcattcacatatgcacacatacatgtacgtatatacatcacattcacacatatgcatatatgtacatatacagctgaagaaggtctggattagtacttttccttattgtggagcacagtgagtgatattttctttttctttttcttttttttttgagacagtcttactctgttgcccaggctggagtgcagtggtgtgatctcggcttactgcaacctccaccttccaggttcaagcagttctcctgtctcagcctcccaagtagctgggactacaggcatgcgccaccatgcctggccaatttttttgtatttttagtagagacggggttttgctatgttggtcaggctggtctcaaactcctgacctcaagtgatccgcctgccttggcctcccaaagtgctgggattacaggcgtgagccactgtacctggccgatattttctattttatttcattttgaaaaagataggctgtgactcattagtagtggatctcatgactaagaatggatcctgacccaagtttgaagagactggtaggggtaaatttagagcctggggctccaaagtttgtctacccagttttaaatcctggctttccccttaacttgggtgggatcacaccattaaccgtgttacccctctgaagctttggctcccacacctgtgagatgtgaatgttgataacacacacccacctcataggattaatgagaacatgccaagatataatgcgctgaaggtcttagcatgcctgcgcagagccccagcatctgttagctgctgctgctgccgctgtggtggtgactgtccttgctaagatgctgcagctggattggcttcgtgggaagttgtggaattctgttccctgaggatgttgggaaggacagattgtacttaccaagagcatttattgttgtttttattttcttaaacatttccaatgaaaatcatcaaacctataaagttgaaagaacaatgcacctagattcatcaactcttaacacttgctatctctcttacatagaaacatttcccttttaccagtccacttggaaattggctatatactcacgatagccaagaacaagaacactctcttacaccatcacatcattgccacacttaaggaaatccacactgatccaggaacattatttgatatacagtccatattcagaatcctccaggtatcagtaatattttaattatgacccatttggtgaatttaagatggattagatggcctgtggagttattcatggagctgaagacttctgtgaagtaaaaaataaccacccagtgttaagtgtaactctcgtgtggaatattaaatcaattgtgtgttttttttggcatccttgatgtgaactctggagacctgatgagatggaggctgtgattgtttactctgtgttagcttggacacttagcttggcagtaatcacaagagctttagggagtgcatcctttgctagttcataaagatgtattctgataacgggggaccaaaaggatatatcctgaattgcaaagtcgagcagtagattacatttggatttgaatgtaagtggctgtgaattagaaatatttgttggaattagaaagtgtctaggtaggaatgtaaggtctcccctcaaattgagaatgacaaggctgtcttctaaggacagaatttaaggtgaacactgtggaagtttgtgcatgtgttttttgtttgtttgtttgtttgttttttgttttttttgtgacagagtctcgctctgtcgcccaggctggagtgcagtggcgcagtctccactcactgcaacctctgcctcctgggttcaagcgattctcctgcctcagcctcccgagtagctgggatgacaggcgggcatcaccacgcccagctaatttttgtatttttagtagagacggggtttcaccatgttggccaggctggtctcgaactcctgagctcaggtgatctgcccacctcggcctcccaaagtgctgggattgcagggattagccacagcacccagcttgtgcatgtgtgtttttaagaaaacgtccacaaggtaaggaaattcaagcaaccaagaaaagacgcttgataaacagtaagtcccatcttgctagtttcttctgtatttctccagggccactttaattgattctaaaatgtacattatttctcatttttaaaaaaaatctctaaaatcagggtacatcttaaaagcaatataatgccatggtttaattggcacatgatttagtgatacataaaataaaggcacctcttgcagtggcatcttcgatttgaagaagtataatattctacgaatatacaaatttctgtgtttttttgtccccccaacccctgcccttttaaagacatatagtaatatagtggggttataggtttatatactgctacttagctgtgcagagaaattacagcatttaaaaaaatcaccaatctgtcttcctcataagtcatcatctagaaatggggagaagcaaagagtggtattttggccagttaataaggtcttatattcttttggcttaaacagtatcttttgggtaaattctggattttttcatatatcctgccatcccccattaaaaaccagcatctggtcttgggggattgtgagatttttgtggaggtgagggaggccctggcctatgcttgctgcctttgctcatctagtctggtctggtctggtccctgggcctttcgcaggtatcccctgaagtgtggttggtggtcttgaatttttttcttttgtctccatcagggccagggaactgtccttgcttccttttggtacattcaccctgcagcagatgtcatggcttccaagtggaacttcactctctttcttactagttaagctacaggaggcttagagtgctaaaaccgagatgcttcccctgcataaggccatgcaacacggccattttattctgtagccatccgtgttgggatgagtggaaggttgcatctgcgaggtggtcttctcctagagtttcaattaggaagtggggcaaaagccccagtgccttcccttcaacctgacgaccagtctaccctctccccacctgtgctagttatcaatttcttgcttgttatctccaaatccattctgctttgccatgtttcgtgacatgggaactggactctgtcaacagttttcctttgcctgctggcgaggtgttaggctttgtcaacagagtgctggagggacatggcaaggtcatggtgggaggagggcgtcctttcccagtgtgctgattttcactggtgagtgagtatcagtggactggcgtgcaagatgcccagaaacacatatcagccatcatagacagcccagtgggtggtaccgtgcaccagctccaaccacacacaccctgcagggagtttctccaccacgtggtgggctgctgccctgggccagctctggatcacgccctctgacaagcatgtttgccaccggcatgctgtgtgttcctgtggagctgtgccctttctgaagagtctgaatctcagctttggggttgggggaggctctcctaagttcttagttcctccctcttcactctacctgccctttttaagacacatagtaatatagtgggctctaagtagtagacactttgttcatttgctacttctgtacccctgggtcctcttttactcttctgtcatttgttaaaaatctcggccgggcgtggtggctcacacctgtaatcccagcacttcaggaggccaaggcgggcagatcacttgaggtcaggagttcgagagcaacctggccaacatggtgaaaccccgtctctactaaaaatacaaaaattagctgggcatggtggtgcatgcctgtaatcccacctactcaggaggctgaggcacaagaatcgcttgaacccgggagatggtggctgcagtgagctgagatcgtgccactgcactccagtctgggcgacattctggaactctgtctcaaaactaaaaaaaaaaaaaaaaaaaaaaaaaaatctcctgtgggacttcagtctgtggaggttattgagtgatggcacagaaaggccaatcccaataaaagaaaatggaaaatgtttattacttccatttccaagaggggagcatgccacgccacaccacacaggcacatggggaagcaccatccacagggcagaaaggagctgggggaacgcccaggccagagcctttgttgggcttctgtgggaaaggccagacagggccagggaaacatctgaggattggctattttggataattctggggggccctggggcagagggccgtccctcgttgtctggttcctagctctgggtgatttagggtaggagaaatattggctctgtgtgtgagagttagataaggaggtggttcagagaatgggctctgggtggcaggggagacggaaacagctttggctgtgtgtgagtttgaccctgtgattagactaatggatgccaaatagatgaatacagaatctcagaaaacacagaacgctctcttagcagtatctactttttgttaataattcttttattaaattttccctattgaaatgactggtgtggtttctgtctcctgactggtacatcacctcttcctcggaatttgcgggcagggaagtgatgatacatgtttgactgcctcctactctttgcaccctgatgtgagggaagggctggacccttctacatctttctgtctggatgaagctcctctgctgtcatttcctcctccttccctagtgcggcaagcagctctgccagcttgtcatagaagggcatttaagtgactttgccaacacaaacagtactgcaatgaagatatgccacactttgcaattagttattcactttaaagttctgttatgatatagtaacttaataagtgaaaaaaacatcttggaccaataaggatggaagaaaagtatcggaaaactagtcagaattaaaataaggactaaatcacgacttttatttctgtgatttctttttgtatttttgaagctcttttcttaggtcagggccaccatggctttttgttgcattgatctctttatcattatatgctgtttctccttaggctctgcaatattccttgctctgagtctactttgtctgataggcacttcagctttcttttgatcacgcttgcataatacaccttttcccatccttttactcgtagcctgcccgtgtcattgccccagtggggaactgctgttgctctttacttggagccaggctcatggtaagaggatggggactttcttggttctcttagtctgactccatcttaggcaggtactgtgtgcctggacttcaggatagggctttcttagcattgtgtgctttcaccctccatgccacctggactctgccttctgtgtgtgtgtttgtgtgtgtgtgtggtgtgagctcccgtgtgagagagaatttcccacgtttccccccaaccccacccgaagctgacttttgcattgtatcagtgcagaatccagcagacgatcatatttgctggtacctcacccccaggagcagcagatctttgcctgggtcccggggacagggaaggtttcttgcccttcccccagtggattacggcttttgcattaggtctgagagaggggctcaggaaggaggcaagattttacccgagtccggtattgaggggtgctctctccagcctcgtgctctgctcccagtcgtcgtcacgagcacctggtagtggcccatggaaaagggtttgcaagtgagttcagacaggaattctagtgttacaccagcccatgctcagctccataagaattcattaaaaattgagatgttttcccgtcacctgttgacatggcagcctcatcttcctcctgtgctctgtgaagggtcacagggtttgcgtgtcccatttctccttggagggatttgtcactgattagaattcagttcacctgatggccttgtggcctcagctctctgattagctcaagaaaagttaggattttgttgattatctggctttttctttttgttgggttgaaagttctcttatggctttctgcatcttaagcaaggggagtagaactctatttcttcacctgtccctcagcagaattatgtaagtaaaataaaatttaggttcctcacagatcagtgcagtttgctaatacaaatactgtatgtatagttactctgttttccacatccaccattggtttaagtttgaacacccctgttttactttgtattttgaaataatttcaaacttacagaaaatttacaagaatagtacagagaattcctacatgtcctttacttagttcgagtcatcaatttttaacgtattgctacattacatttgctttaccatttccccccttctatatgtgtatgggtataaaatttgtttttcggaatcatttgggagtaggtcacaacattttgtccttttatcccttaatatttcaagtgtatgttgtaagaacaaggatcttctcttatgtaactatagtataattattaactttaggaaatttaactttgatagaatatttttatttaacctaaaatccgtattccaatttcctcaattctcccagtaatgtcctttctagcaattacccccttgggtgtaggatccagtcctggatcatggattgcattaatttgtcatgatctttaatatcctgtaagctggaacagttcctcagtctctctgccttgcatgacattggtatttttcaaggacatggagcagttattgtatagaatgtttttcaattttggctggaacatttcagtttcagtttgtttgatgtttccttactattagattcaagttacacatttctgttttagaatattacagaagtaatgctgtatctttctcatggtgttacatccatttgcataccttgtctttctgcctgtcgttaatgatattaattttgattatttagtcaaggtactgtctggttccttcattggatagttgctagttttcctcttgcatctatttgcttttcggtttttgttttttcccttaactttttctccctgtgatttcctgaaacctcttgcatctaaaaagcaatctgtggggagacattttgtgaccatataagtaacctgctcctcatgaaacataaaatacaaaccttgggttctcttagagtggagaaagggatcagtgatccaagaccgtttctcataaagctaatacctcagagaggctacaccatcagagagaaaatgtacgggggagaagcacattacacagtatcaatcagaaaggaatatttctgtctgagctttcactttgagtggagggcaaagaaaaaaaatcacatgagaacttgtggctgctgaccagctgctcccacatgggtgtagaaactggttttatcctatctgtgtgacctccaatagctgcaagttggaaatcttgatttagagtggacctaggtttttaccatccctgggtgcttgacaaaagcaagtttaagtcttccctaactcagagtttccatagatcattgcagccaatatgaacacaccaaaaaaggacatacacacacacacacacacacaccctgaaacaagatatcatgcgcaagagtcagtagaaacaatagttgttcctgacaatttcagatattggaaatattgaatatagactataagttaatttactacctttggggaagcaaaagaaggaattgaaaatatgaggaaagagagagatacatcaaaaacaaccaggcagttttatttttaaaaatcaaatataatgttcagaagtaaaaagcataatcattgagataaaaaatttatggattggttaaatgttagaatagaaacagcagaaaccagaattagtgaactagaagataagtctgaagaaataacacagactgaagctaatagaaacaaagggatgtaaaccacgagaggctcagagatatagtgagaaggtccaacttatgtctaattggagttccagaagaagatactacagggaatggcaaagagagaatattgaaacagataatgagtgagaatcttcacaattgatgaacaacaggcctttgtctgtcatttgtggaagctagcacaacagtttaaacggaggcccataggccatgtctaaatatttaaaagttacaaatgtgacagactgtgaaataaaatatgtctatactcctaccttgacaaatatgtctctctgatactctagaagatgaggtttaaatgtagagttcttgaactccacagagctctatgctggcacatagcagcacagagtgagccagaccttcgcctgtggcccccacccttttgtctttcttcccgcagctttatccatgctgtgaggggcctcatgcacacatgtgtacatacttcagcctgcatatctaagctgtgttcacgctcctcacaagcatgcttgtaggtggcaactctggcctatgcccgtatgctggtgcattctactttctttcatttttattttatttatttatttatttatttatttatttatttagagacagggtttcattctgttggccaggctggagtgcagtggtctgatcatagctcattacagccttgaacttctggactcatgcagtcctcctgagtagttgggactacattaattaccacacctagtattttttttttatttttattttttgtagcaacagggtctcgctgtgctgcccaggctgggtttgaactcatggcctcaaacactctttctgcctcagcgtcccaaagtgctgggattacaagcatgagccactgtgtcgggccagcattccactttgataatagacctgtggaaaaggcccatgcaagtcctgaatgtgggcatggattcaattaagtagggaattccaggatcctggatacctagaatatggtgatcagactcagggtgggtgcatctccttgggccttcaggccccttgccctgtggggagaggtggagtcttttaaattatagaatctagggtaggggcctctcttggaacaggttctaagggtggtaatgagagacaaaaattctctggttcaggaagcccatcaaattccaaagcggcaaagaaggaaaggaaagaaattcatgtctaaacatatcagtaaacctgtgaacctatagaacatcaaaaccagaaacgattcttaaaaataggaagagagaaaagacagattacctacaaaggaacaacaattcatatgccagctggcttttctataccaagagtggaactactgaaacagtgttttcaaagtaggcagtgaaaataactgttgatctagaattgtgtagccatgaaacagcctttaaataatgagaacgaagtgaaataaagacattagataaataaaaacaaaaagaatttactgctgagaattcatcactgtgatggttaatattaggtgtcaacttgattgggttgaaggattgtttctgggtgtgtgtgtgagggtgttgccagaggaaactgacatttgagctgggggactaggagaggaagacccaccctcaacgtgggtgggcaccatccagttggttgccagtgcagctagaacaaagcaggcagaagaaggtgggataagcttgctgagtctcctggcttccttccttctcccatcctggatgcttcctcccactcctcctgcccgtccacataagactccaggttctaaggcctttggactcttggacttgtaccagtggcttgccaggggctcttgggcttttgccacagactaatggctgcactgttggcttccctggttttgaggctttcagactcggactgagccactacgagctctctttcccggcttgcagacctcatatcgtgggactttgccttgtaatcatgtgagccagttctcccaaataaactccctttcatatatacatatatcctattagttctgtccctttggagaatgctgactaataccatcactaaagaacatcctcaagaagaagggaaatgacaccaagaaggaaggtttaaaatttaagacaacattaagttgatccagagagatgcattaacttgcctaaagatcacacttggttcagaaccaagcctagacttaaaccgagacaggatgcaagaaagaaatcaagttaacgacagaatttcattttcacccaggaagtagacacagggtcccttggggctcattttgggagaaggcctacctttttcccaggacacaccaccatttacacgtcgagtcttacagcctccaggactttaagcttcccactgctaatgtgtcatttttcctttctcttgccactgagttgtttgctcaactagaggattttactttctgcccttcaagttcacatggtagctcgcatggtaacataagtgagtcttggcagtgttgccagggacaggatgactttaatttcattcctcctcatcttgatgctttttttccctttccagttcccatcagctacttccctacccctagtggtcctatgagtccttcagttctccccctttctccatgacacaccaggagccatgtcagatgtgatttctgacctgggaccctgaatggcacaaggagaagaagtacggaattgggggagggtataagagggtttaagatgcgtgaaaaatgttgagtaggacatttcaagagatagttcaaataatatggtaccttttgtttacgtcaccacacttggcaaatttgatcgtatgacatctcatttgatgtctttgagatgacagatgttgtccctactgtagagctaagatcctcagagaggttaaatgacttgcctgtaatcactaagttagaaagtggcagagccccagaactaccccatgcagctgctttctagtttctaatcaggtgctttttcactaacaccatcttgcctctacaaactgacggcttacaaaatgctaccaaagggtaatactttttatttttgagatggattttcactattgtcacccaggctggagtgcaatggcacgatctcggctcactgcagcctccgtctctgaggttccagcaattctattgcctcagcctcccgagtagctgggattacaggtgcccgccaccatgcccacctagtttttgtatttttagtagagacggggtttcatcatgttggccagactggtcacgaactcctgacctcaggtgatctgcccgcctcagtctcccaaagtgctgggattataggcatgagccaccgcgcctggccaagggtaatactttttaatcagccaataagattcacatggaatttgcttatttttagtattcctgtcagtattgatggatttctttaaaagttttttccatagatctatttgcccatcacctctccaactcctccagcatctgccccctttcttccgcatacatattgtgatgtctaactgggccttaattatcatgaattttaaattggtggtatccatactaatcaggatttcctgtaattggaacattcttcacacttttgatatttgctgattgtcctctctatgcattttagaagtttcagactattttttctgagaaataactagagtctgtgcaagctgtgtcgtacattttgactgcaattttagtactgagtgttgcttgcttgaaaagaggcaggtaaaccaagttattgagtgcagtttcaaacacaagccaccactgttccatagatcaggggtccccaatccccaggccacagactggtcatggtctgtggcctgttaggaaccaggccgtatagcaggtggtgagcggcaggtaagcaatgaagcttcatctgtatttacagccgctccccatagtactcattactgcctgagctccgcctcctgtcagatcagtggcggcattagtttctcataggagcatgaaatctattgtgaacagtacatgcgatggatccaggttgcgtgctcctagtgagaatctaatgcctgaggatctctcattgtctcttatcactcccagataggactgtctagttgcaggaaaacaagctcagggctcccactgattctacattacagtgggttgtataattattatatattacaatgtaataataatataaataaagtgcacaataaatgtaatgcacttgaatcatcccagaaccacccctcagtggccccatccccagtctgtggaaaaattgtcttccacaaaagcagttcctggtgccaaaagggttggggactgttgccattggatcatgacacattactatcttgttgaattaaacgttgcaaactgcaacgtttgtaactgccagtaggcagtttttattttatttttcattttttatttatttttttacctgtgagcccacatccataaagttagcagactatgtcatagtcaagagactttgctttatgaactagctgatttagtttgctcacaagctttgaaagagtctttttttaaaggccaagtttaagacaccttagaccatagaaatatgtgtatttcctggccattcgatcatttgaaggccagattttatcaaaacaaatgaatcactgtttctccttccttcatcattccctaattggtttccaaaataaaatgattagtggctgcatttctcaactgcattgttttgattacagtcttactggctgtattgggtgagacattgggaaatgctttcataactggtgatcactgttgacggggttccctgacttcataaaggcccagattatgttaccccgagaaagtctttgaaggagcaagctctttcttatgcttttgttattaagttagggaaaatgactttaaataatggaaccttagttacaatgtaggttccactcttcttgagatttgtgttactttttagacatgacaaaagtgtgcattttagagttcctcttaccccaggaacaatggactcacttggctttcaaaagggcagaatatactgagtatttctgactgcaggtttcttctttctggtaccctcaaaaatacaccataaatagtagattaatctcccttttgctgtccgtgagtcccttcccgtttcttcagcactgcttgatatgactggtatggaggcctaaagctggctggcctagttagtgttacccaagtggtttcttgtgagcatccatttgcatgcagttgggccttttgtccattggtgaactgctccttgccttgaggtcctgtagctagtttgccactgagtatttccttcaaaaaacaggaaggatgccctgatattatgaagtgggtggttttagaattccacttcagatggcactgacctttccttaatacagctggtttcacttaatacattttgtttaaacaaagcctgttcctggaagtggttccagaatagtctgttccttgtagctgttcctttgctcttaattttaaaagtgttttcccgacagtatcatatgtgctcgcacgacagattagaaacttctgcttgaagtcatcacacttatgaattacgttgtgtccagttatgatatattgatgattgtattcagtagcttgaaggtttaagtgataactttattttgcaaaactgaccacattcttttgttgcttaggtgtctcccctttaagggattctgatgtctagcagtctcaatggacaaaacagataaaagagagaatgagtatttttcactttgtaaacatgaacaattcttaacaaaaaagccagagctggactaattaaataatcaacatgttttaaagtgggatagacatttctattttaggtatgataccacaatatttaaattttaggaaagactggatagaaatataaaataagatactagtagtcctgctctgacttttctaaaacaagtttatattactttatttaaaaatgtttatgagagtgccttttaaaaatagggatttataggctgggcgcggtggctcatgcctctaatcccagcattttgggaggccgaggctggcggatcacctgaggtcggagttcgaggctaaaaccctgtctctaccaaaaatacaaagttagctgggtgtggtggcatatgcctgtaatcccagctactcgggaggctgaggcaggagaattgcttgaacctgggaggtagaggttgcagtgagccaagatagtgccactgcactccagcctgggtcacggagtgagactccgtctcaaaaaaataataataagataaaaaatagggatttataaaacatatatgcaactcattaagaactttttggctggccaccatagctcatgcctataatcccagcattttgggaggccgaggcaagtggattgcttgagcccaggagttcaagaccagcttgggcaacatagcgaaacctcatctctacaaaaagctgggcatggtggtgcgttcctgttatcccagctacttggaaggctgaggcacaaaaatcacttaaatctgagaggtggaggttgcagtgggccgagatcaatcacaccactgcacgctagcctgatgaaggaaggagaaacagtgattcatttgttttgataaaatctggccttcaaatgatcgaatggccaggaaatacacatatttctatggtctaaggtgtcttaaacttggcctttaaaaaaagactctttcaaagcttgtgagcaaactaaatcagctagttcataaagcaaagtctcttgactatgacatagtctgctaactttatggatgtgggctcacaggtaaaaaaataaataaataaacaaaaaacaatgtctttctctgccttttgttaaaaaaaaaacaaaaaaactttttttgcctgtaatcccagctactcaggaggctgcggcaggagaaccacttgaacccgggaggtagaggttgcggtgagctgagatcacgccattgcactccagcctgggcaacaagagcgaaacttcatctcaaaaaaaaaaaaaaaaaaaaaggcactttttttttggccaggcacagtggctcacgcctgtaatcccagcattttgggaggctgaggcgggtggatcacgagatcaggagttcaagaccagggtggccaagatggtgaaaccttgtctctactaaaactacaaaaattagccaggcacggtggcaagcgcctgtaatcccagctacttggaagggcgagacaggagaatcgcttgaacccaggcggcaaaggttgcggtgagccgagatcgcgccactgcattcgagcctgggcgacagagtgagactccatctcgaaaaaaaaaaaaaaaaaaaaaaaaaaaaagaactttgaataaacttcgttgtgtcatattctatcgtaagatttattcttgtctttggagaacttagcttataattaattatattttaatgaataggatactttttgtttgttttgtttttgttttgagacaagtactcgctctattgcccaggctagagtgcagtagcatggtcttagctcactgcaacttctgcctcccaggttcaagcgattctcgtgcctcagcctccccagtagctggtactacaggcgtgtgccgccatgcttagctaattttcatatttttagtagaggcagggttttgccatgttgaccaggcttgtctcgaactcctagcctcaagtgatccgccctcctcagcctcccaaagtgctgagattacaagtcaccacgcctggcttccgtatttaagtattaggtggtgactccatacaaaatatttaacagcttgctggttaacatttaaatctttgttgctaagaccttttctatgtttgacagttattccaaacacgttccatataggaatagtttgccaaatagaagaacacgggatattcttctcccatggctgatgtgttgtgattctaggtgcatatttctgtttccaagaacacggacctgttctcaagttcaaacactgcatcaagagactgtgccccatgtcttttcacttttttccctctctctttctctccccttcccctccttgatttaatttcttcagcaggtcagaattgatacagcttccagaagaaatagtagaagtaggcaaaagattagtttttaattcttgttctgtcaaatactttttgattgaaattgtttttattacaaaggtagcatttgctttttgaaaaacaaaataagaaaaatctttttaatcacttcactattaagtttgttgaatattccctcataactttttctcctggctttttgagtatttgagacatttctttccacattgcagttttgaaacattctaccccacactcatacatgaaagtgaaggctctgcttctcagagtacagtttaatttactttgtggacatcattaacaaaaggcagagaaagacattggaccatactaattgtgggacttagaaaagctatattagtgatggttattaagtatcgcttgcagtggagtctgtaacatattcctatgaagttaatctaactactgagatagtgggagtgcagaggaggcatgctgtgagatggagtggtattttccagcatggcttttctgtttcttgaaaaccctacagcactttgccatggtttctcatctggatgaaataaagcacctgtaccttagtatgtcctgccatgcctttgtatggcatacttggctttgttctccaggcctcttcccacagtaacaacggattctttaggaattggaagggggggccgggcatggtgactcacgcctgtaatcctgggactttgggaggctgaggcgggtggatcacgaggtcaggagtttgagaccaacctggccaatatggtgaaaccctgtctctactaaaaatacaaaaaagaattagctgggtgtggtggggcatgcctgtagtcccagctactcgggaggctgaggcagaagaattgcttgaacccaggaggcggaggttgcagtgagctaagatcgtgccactgcactccagcctgggtggcagagactccgtctcaaaaaaaaaaaaaaaaaagaattggaagggaatggaggaagcaaggtggttaaacaaaaatcatctttacacacaccacccactctatgatgtatatgagttcagaagagcactttgctttatccttaatagaaatatctgtaaagccaggggagtcataaagctgtaggctaagtaaggtgccatgagaaaaggaggcttcacttacgccagtatttggagcagcgtttggcctcttggaggtgtttgcacccatcggagatgctccatagtgagatttaggataagtgcaaggtgagctttgcttttgtaaaatgcatgaagtgtgaccacgaaagggccatgggaaagaattattgatgggttacaggtgcatcgtttcaggcagattgacactaggaaagagcaaagagcaggtagaggtttgacagtttactcctttaaagtaatccatgtccaataacccatggaaagtcttcatgtacttctaaggggtagacataccctagtctaggtgctaatctaggttctatcatgtgttagctgtgaccctgggcaaataactttatcctatggcctcaatttcatcttgcaaaaaaatacggattagataatggcacttccttaaaaggtttgatgggatttcaatggaatattgcatagaaagtgcttgaggcattgtaagtacacagtaagtgaagtgttgaccattattaatatcatgatgataaagtgtgtaacttattttataagtaccatataattgaaatttgccaatagtaactcctcggagacttccagggaactctgtcaatcaaaaaaagctttgtgtaataatggacgctaccttgacagagtgtgttagtcaagagaggatacttatttataaattttgggatatttatacttttttttttttctttagagatggagtcttgctctgtcgccaaggctagagtgcagtggcgcaatctcggctcactgcaacctctgcctccccagttcaagtgattctcctgcctcagccttccaagtagctaggactacaggcacctgtcaccaggcctggctaatttttgtattttttaggagagacggggtttcaccatcttggtcaggctggtctcgaactcctgacctcgtgatccacacgcctcagccttccaaagtgctgggattacagacgtgagccaccgcacccaactataaaatgtatttttatagatacttattgaattttaggatgtgggctgggtgattattttttaaagtacttttaaaaaaattaaggtattatttacatataatatccacccatttttaagtatacattttggtgaattactgtgtgtcaatcatgtaacctcaaacacagccaagattataaaacagttctctacgctgctttggtgatggatacaccaaaatctcagaaaccaccactacagaacttattcatgtaaccaaacaccatgtgttccccaaaaacctattgaaaaaaaaaaagaacccaaaaccaaaaaacagttctctcaacattaaaagttttcctgtgcctttttccagtggattccttccctcagcctctggccccagacaaacacttatccactttctgtgtctgtagttttgtcttttcaagaaattcctatgaatggaaccatataaaagttatataaaaatcatagacttttgtatttgatttcttttactcttagcatcatttttttgagatttactcctgttgtatgtatttacatttcctctttttcttggtgagtaatattgcattatatgaatatctcacaatttatccattttactagtggataacattagattgcttccaacttgaggctattatagtacagctgctatgaacatttgtgtattcaccattgtgtgagcatatgattttccctaccttcttttctatttcactttcttttcctttttctttcctttttttttttttcttttttttgagacagtctctctgtgtcgcccaggctggagtgcagaggcacgatctcggctcactgcaacctctgcctgctgggttcaagcaattctcagcgtcagcctcccaagtagctgggattacaggggcccgccaccacacccagctaatttttgtatttttagtagagacggggtttcaccctgttgaccaggctggtcttgaatgcctggcctcagtgacccacctacctcagcctcccaaagtgctgggattataggcctgagccacagtgcccggccctttttcctttctttttttgagataggatcttgctcaatcatgcaggctggagtgcagtggcacacttggctcactgcaacctccacctcctgggttcaagcgagtctcctgcctcagcctcccgagcagctgggactacaggtgcgtgccaccacgcccagttaatttctgtgtttttagtagagacggggtttcaccatgttggccaggatggtctcgatctcttgacctcgtgatctgcctgcttcagcctcccaaagtgctgggatgacaggcgtgagccaccaagcccagctgacaatggattttctttgttttctccttcatctgaagatgtcttccctttgccttcatttttaaaggatattttctctgggtatagaattataatccgagagtatagaggttgacaagttttttggtattggttttagttttgggttgtgtctttttgttgttggcttttgttttgtttttgccccttatagatgtttcactgtcttttggctcatgtgttccgatgagaagtcagcccttcattgggtccttgttctcatctgtttaatacctgttcccatacctgccctttctctctcactgcttttaagatttgctctttatctttggttttggagtatttgactatgaagtgcaagctgctttgtttcttcttggtgtacattcagcatcttgcatcttcaagtatctgcgtatcattaagtttgggcagtttttggctcttgtttcttctaaattttttctaccccattctccctgtccctctccttttggtattgtagttacccactggaacacgtgacattatgtagcaagtctctgagtctgttcatttttttccttcagtctttttttttttttttgaaatggtctctctctgttgcccaggctggatggtacagcggtgtgatcacgactcactgcaactttggcctcctgggtttaagccatcctcctgcctcagcctctttgagtagctgggaccacaggcacgtgccaccacgcctggctaattttttgatttttactagaaacagagtcttgccatgttgcccaggctggtcttgaactcctgggctcaagcaatccacctgccctggtctcccaaaatgctaggattacaggtgtcagccactatgccagccttttcaattttttatctctcttcttcatcttggttaatttctactcatcttttttgaaatgcacatactgtccttttctttgtccattcagctgagtatatccagtgaattttttatttcaaaaagttaatttttttcagttctagaattgccatttaattattttttgttgttcctatttcccccattgagatttcctacttcttagctgagattttcattcattggaaacatgccttatactgcttcattgagatgattataatagctgcttaaaatctttgtctattccagcattttgttgatctgcaggttagactggcagttgaactaatttgtcccactgtcttgcttctttgtatggtgggtagttctggattgtttactggactgtatgaatgtcaaattctggatattctggattctgttacttttctctaatacttgtttggttttatcaggtggttttcttggctgggtttgaacacaaatgtgtttctctctgagatctttagtctgtagctgagctgctttgtgtctgtcccatgcatgagtggctcaagggtcagtcagggatgtgattgtacggggattggagatcttcccctgcctttttcccttctaggattacttcagtctatttatttatttgtttatttatttagagacagaagtcttcctctgtcacccaggctggagtgcaatggcgcgatctcagctcactgcaacccctacctcccgggttcaagcgattctcctgcctcagcctcctgagtagctgggattacaggcccgcaccaccacgcccggctaatttttgtattcttagtagagaaggggttttgccatgttggccaggctggtcacgaactcgtgaactcatgctctacccgcctcagcctccccaagtgctgggattacaagcgagagccactgcgcccagccggctctctttgttattcatagtttcctggcttctcttttctgagccacccagccaaaaatgctttgactttttctatgcatgtttctgtcatgtctgtgcatgacataaatcataatatcctaagacacaaaattgttaaaggcaataatttggaaacatacaacaataaataaaatggttatagagatgtaactttaaaaagttgaacattttgttaaaacgattcctgaatatgctggaaaattcagatagttaacaaaatattttgaggataaaaaggaaaggaatctgttatctggaggtagaataacttggccattttacagaaaggaaacaaattctgatttcactttttgtatatcatccatttgacaattttcaataaaaggtttattgaaaacggaatacataaggctggtgtttggacctttttcctaattagaaattgtccatgtctccaaagattattaactcagtttattatcagctaaagagatcttaaagttgactaaacacctggaaattaaaacttaggccaacacatcaaagtctttatgacttgaagtgttttaagaattaatgaggcaaagcacacacctgtggtcccagctacccaggagactgaggcaggagaactgtttgagcccaggagtttgaagctgcagtgagctatgatcatgccactgttcttcagcccaagagactgagtgagacctcttaagaaaaaaaaaaaaatgaccggacacagttgctcacgcctgtaatctcagcactttgggaggctgaggcgggtggatcacgagatcaggagatcgagacaatcctggctaacacggtgaaaccctgtctctactaaaaaaatacaaaaaaattagcagggcgtggtggtgggcgcctgtagtaccagctacctgggagcctgaggcagaaaaacggcgtgaacccaggaggcggatctcggcagtgagctcacaccagtggctcacacttgtaatcccagcactttgggaggccgaggtgggcagatcacctgaggtcaggagttcgagacaagcctgaccaacatggagaaaccccgtctctactaaaaatacaaaattagtgggcgtgtggcgcatgcctgtaatcccagctacttaggaggctgaggcaggagaatcgcttgaacccgggaggtggaggttgcagtgagccaggatcgcgccattgcactccagcctgggcaacaagagccaaactccgtctcgaaaagaaaaaattcatgagactaaatcattttaaaaagatgtcttttattacaatttctttcaattaaacagttttatatttttgaaattttaaacaatttgtgcaaacgagatcctactggacctataaaactaatgtagttaatttagaaggtttaaatcacgagaagttaagcccaaatcttgggttgatttaattgttgtgttaacattgtttttatatcataataaaatcagaaggatgcatagacttgtttttaagctaatattaacttctatttctagcccaaagagtcatctatcaaaagccagctcatattaagtagggggaccaagagggaggtctctcagttaaacaaagttattgacttgtctttagacaggcaagacagagtatctcctcataaggttttcttttaacctttttgttctgaagttaatatgtcttttaagtgaataatcttgtttataacaacattttcttttctgttttgtttgtttgtttgtttgagacagagtctcgcactgtcacccaggctggagtgcagtggcacagtcttggctcactgcaacctctgcctcctgggttcaagtgattctcctgcctcagcctcccgagtagctgggactacaggcacatgccaccactcccatctaatttgttttgtgtttttagtagagacggggtttcacaatattggtcaggctggtctcgaactcctgacctcgtgattcacccacctcggcctcccaaagtgctgggataacaggcatgagccactgcacccagctataacaacattttcaaagtggcacattttaatatgaataaaccttctacaatcacaggcctagaaagtttttctttttcttacggaatttcttgactgtttacttgtactagatatttcttcggtatattcataatgacagaacaattgtttatgattgattgatctccaaagtttcccaagaaaagagaaaaagtaggaggggaaggaagaaagaagtgagcagaagttggcttcagagagataggaagggccagttcccttctctgtttaaggaggggagaagacttagatgcagggaaactcattttgacatgccaactcaaaccacagaagccagagtcagttcagctggtttcagtagtaactcaggaccttgacaattctgttaagccatgtcctttaaaagccagctcttattaagtagggggatgaagggggaagcccttcagttaaacaaagttactgacctgtcttttagacaggcaggacagaggatctcctcatgaggtttttttaacctttttgttctgaagttaatgtgtgttttaaatgaataatcttatttataacaacattttcagcgtggcaactgcagtttcagaatggtggaattataccagtcagagagagatgcaaatgatttaaaataggaagaaagcaggtgtctggcccagaggaccagattaagaagaccccatgagagttacaatagttagtgaaaatggtgcttctgcaaacctcatgtctacagaagctggtcaaagaccagatgccaccaggtagaatcccagcaaactcttcaatggtagatatctgtcaccatccttaggaggtaggtctgtggaagctcactataataccatttgcttaacagatatacaaacatggatcagatataatttcaacccacaaggagctcacagtctggctcttcttttgaggcaaaaagactaaagctgttgcctttatggtaagataaatctgccttggagtcaatccaaggtgatttaattactgtaggtagttgtaccaataaggcttgtatcccagagaactccatattgcatttaagcttgttagtaagccaggccagctctatttcctgtgaggactttaaaaaaaattgcattcacacatttaaaaattagcataagcagggtgcagtgatgcacgcctgtagtcccagctacttggtaggcagaggtgggaggatcacttgagccccagaagttcaagaccagcctggacaacaaagtgaagtgaagactgtctcaaaaaaattaattatgacataaaatgttatatgtcttaatttacacaaatataagtatatacttttaaatcccattcttacacacaaaagctagcatactgtgtaaagtattctggacctacacacctttatttttttaacataacaatatgtcttggatacattttcctatttgtctatagaaagtttcatcattattttaaaaaatttgtttttggctgggcacagtggctcatgcctgtaattccagcactttgggaggccgcggcaggcgaatcaggaggtcaggagtccgagactagcctggccaacatggtgaaaccccatctctactaaaaatacaaaaacttagctgggcgtagtggcgggcgcctgtaatcccagctacccgagaggctgaggcaggagaatcgcttgaacccgggaggcagaggttgcagtgagccgagatcctgccacagcactccagctggggcgacagagtgagactccatcttaaaaaaaaaagtttgcttttatatttcatacctgcatggtattctattgtgtgagtaggccatcatccagtggtcttcaaactttcctgtgtactccgtaacagaatttgttgttttgacatgcagtctcactctgttgaccaggctagagtgcagtgccacaatctcagctcactgcagcctccacctcctgggttcaagagattctcatgcctcagcctcttgagtagctggcgcatgccaccatgcttgactaatttttgtatttttagtagagacgggatttcaccgtgttggccaggctggtcttgaactcctgacttcaagtgatctgcccgccgtggcctcccaaagtgctgggattacaggcttaagctaccacgcctggtcttctaatagaatttttaaaaactgtatttacccccttgcacatttaaattgacatctaagatttttattataagtttaaatagttgtaaaggatgtattttccattatattttatacattccttaattttatatatatatatatatatatatatagttttttttttttttttttttgagatggagtctcactctgtcacccaggctggagtgcaatggtgcgatctcggctcaccgcagtcactgcctctagggttcaagagattctcctgcctcagcctcccgagtagctgggatcacaggcacccgccaccatgcccggctaatttttgtatttttagttgagatggggtttcaccatgttggtcaggctggtctcgaactcctgacctcaggtgatcccccccacctcagcttttcaaagtgttgggattacaggcgtgagccactgtgcctgccctcccttaattataatttaaaaaatttttgcagatgtagatttatataaattggcaagccagttctctttatcaaattaactgatcaaaaaaaaaaaaacagattaactggtcaaacatagatttactttctgtcagtaaaattttgacttcatttttttaaatcaaataagcatgttaacccggtattgctgtgacaacctttatcctaatttcttttcttcttcttcttcttcttcttcttcttcttcttttttttttttttgaaatggagtcgtgctctgtcacccaggctggagtgcagtggcacaatctcggctcactgcaacctccacctcccaggttcaagcaattcttctgcctcagcctcccgagtaactgggactacaggcatgcaccaccacgcctggctaatttttgtatttttagtagagatggggtttcaccgtgttggccaggctggtctcgaactcctgacctcaggtgattcgcccaccttggcctcccaaagtgctgggattacaggcatgagccatcgcacccagcttttttatcccaatttcaagatgggtgggcaggtaggtaggtaggcaggtgggtagatagatagggccttcagacttgcctcgcattcatcttttacataaaataagacagtttcaccttgaacacttctgtggtgagactgtttagtcttgtagctctaaactccagccatactctgatgactcccacatttataaatcccagatttgtatactcaactacttatctaacaggtcaaaactgaactcttaaaattcttacatttgtgtccacacatgattggctaagctaatggggctcagatttaccctgtcacctgaaacaactgtaaaactggagaaaatatgtcaaactctgaagttattaggtctaaggtgattaagaacagcgaatcctgagacctgagaaatagagccctatgattgctctgatttaatgctcggagaaagtttccagaccgcggtgcggggagaaggaacatcagcaggccccagcagtctctcctcattgaagaggtaaaatgaaaatccagggcagctggggcagctagagttcacaggcagagaaacaaagaggcaagagatgcacagagaagagaacactggcctgcagatgcccagggagcccactcgagtattcggttgagtactgatcagtgcacccatgtgaggaaaccccttagttcagggaaggagccactcaaaaggattagagagaaccatttacggagttcacacagggccagaaatagttcctgttcccagtagcagagtagaacatttcatgattcaggggtattgattggagtactaagaagagttgtattagtgaaggttcttgagagagagagagagagagagagagagagagagagagtgtgtgtgtgtgtgtgtgtgtgtgtgcacgtgtgaagaaatttattgtaaggaattgccacgtgattatggaggctgataagtcccaaaaatctgcagggcgagtcagcaagatggagacttaggagagccaatgatgtggctatagtccaaaggctgacaggctcaagacccaggcagagccaatgtttcagttcaagtccaaaggcaggaaaaaagttgatgtcccagttcgaaggcagttaggctggaagaattctcttttactcaggaaagggtcagattttttgttcaattcaggcctttaacagattgaatggggctcacccacattagggaggccaagctgctttacgcattttgccagactaacgtttgaccaaagatctgagcacgtatggcccagtcaagttgacacataatgttaatcatcacaaaagtcttgcctcaatagttgggaaaaattaatcctagaataaatgctattctggtcttgcttagcaaaggttaagagcaagaccaaaaagatcaaaccttttccaaacaaaagctgaagaatatttttagggatacaaaaccatctaggaccgagtgtggtaaaatgcacaatgtttaccagccattccagaattactaggtatgagcagaagtagtaacatacaaccaataactgaccagaaatgagacagattatataagtagtacattacagacattagtcattataattgtattccatgtgttcagtaagctaaagaaaagatttaatatgttaagtaaagacatgaaagatgatggctgggcatggtggctcacgcctgtaatgccagcactttgggaggccaaggtaggtggatcacctgaggtcaggagttcaagaccagcctagccaacatggtgaaaccccacctctactaaaaatacaaaaattagctgggtgtggtagcgtgcacctataatcccaactatacgggaggctgaggcaggagaatcacttgaacctgggaggcagaggttgcagtaagccaagatcgtaccactgcactccaacctgggcgagagagcaagattccgtctccacaaaaaagaaagatacagagatgaaaaatacactgaagactgtcagaataaacattgcacaagtaaagatttgtgattttgaagacttaaccatagaaactatccaaaatgaagcagaaaaaaaaaagaaaccctgaaaaaaatacatgaacacaacatcagtaaagtgagggacaacatcaggtagccaaatgtgtgtggaattggagtccctgaaggaagggagggtatgagggaccaaaaaatatatatagagagagaaaaaaaaatggctgaaaaatttccaagtgtaatgaaagcagtaaacacacagatccaagaatttcaaggaactccaagcacaggaaacatgaagaaaaactatatactaaggcacatcttaagcaaattgcttaaaaccatggtttaaaatggccaaagaaaaagatacattatatacttaagatcagggtgacaccagatttctcattggaaacaatgtaagccaggttaacagtggaacaatacatttaaagcaaagaaagaaaacagttgtctacctagaattcttttctcagtgaaaatacctttcaaaaatgaaggcaaaataaggtctctttcagactttaaaaaaaaaaaggaagaatttattaccagtagatatgcagtacaagaaatatcaaaggatgtaattaaagcagaaagagaatgataactggtagaaaactggagccaccaggagtcccaggctgcagtgagctatgatcgcaccactgcattccagcctgggtgacagagtgagaccctctgtctaaataaacaaacaaataaaagaaaactggagctataaaaataaatgaagacaatgcaaagggtaactaagtggataaatacataagatattttttctttttgtttcagtctcattaaaagatatgtcttagaggtaattacacattgtagcatttgtaacttacatagaagtaaagtttatgacaatagcagcacaaagactgggagtgggagaacaaatatactcttgtaagctttttacactacatgtgaagttgtataatgtcaattgaaggtagactgtgataagttaaagatgcatatgataaaatctatagtagcagagttatagctaatgagccaacaacaataaaaagttgggatataatcccaacactttgggaggccgaggtgggtggatcatgaggtcaggagttcgagaccagcctgaccaacagggtgaaactttgtctctactaaaaatacaaaaattagccgggcatggtggtggcacctgcccgtaatctcagctactcgggaggctgaggcaggagaatcacttgaacccaggaggcagaggttgcagtgagcggagatagtgctactgcactgtagtctgagcgacagagtgagactccgtctcaaaaaaaaaaaaaaaaaaaaaaaaaagttgggataaatatctttaaataatccaaaagatggcagaaaaaaaaactaaacaggaaaagcaaacagagcagatgggacaaatatgaaacaaagagcaagatggtaggttaaaattcatatcaataattaattcaccattaagggccaggcagagtggctcatgcctgtaatcccagcattttgggaggtggattaggaggatcacttgaagccaggagtttgagaccagctttggaagccaagtgagactccatctctacaaaaaaaaaaaaaaaaaaaaaaattagccaggtgtggtggtgtagttccactcaggaggctacggtgggaggatcacttgagcccaggagtttgaggctacagtgagctctgatcacaccactgcactcctccagcctgggtgacagcgagattccatcttaaaaaaaaaaaatcctcattaaaagcagacattgtgagattggataaaaaagcaagacctatttatatttatatgctgtctacagttatcccactttgaatataaaaatacaaatacgttaaaagcaaaagagtggaaaaagatgttaatatgttaacattaatgaaaagaaaaccttagtggcatattaaacaaactatattttaaaatgaatgtcaccaaggataaaggagaattatttcataataataaagagatacattcatcaagacataattctaaatgtttatgcatgtattaacagagattcaaaatacaaacttttcaaggagaaataaatctgtaattatagttgaaggtttaacaactctctcacaaaaactgatagaacaagtagacaaaaatcagtgaggatatagaagatttggacaatataatcaactgacttgacttaattgatgttcagtagaacattcgacccctaaacagcagaatacacgttcttttcaagtgcatatggaactgtttccaagacaaatcattttctgggccattttaaaagcctcagtagacccggcgggttggctcacgcctgtaatcccagcactttgggaggccaaggcgggcggatcacctgaggtcaggagttcgagacaagcctggccaacgtggtgaaaccccgtctctacgaaaaataccaaaaattagctgtgtgtagtggtggatacctgtaatcccagctactcaggaggctgaggcaggagaatcacttgaacccgggaggcagaggttgcagtgagccgagattgcactactgcactccagctgggcaacagtgagactccgtctcgaaaaaaacaaacaaacaaaagcctcagtgaatgtaagctgattcaatttgtagaaagtatgatctctggccaggtgcggtggctcacgcctgtaatcccagcactttgggaggctgaggcgggcggatcacgaggtcaggagatcaagaccatcctggctaacatggtgaaaccccttctctactaaaaatacaaaaaatcagctgggcatggtggcgctcacctgtagtctcagctactcaggaggctgaggcaggagaatcacttgaacccgggaggatgaggttgcagtgagccgagatggtgtcactgcactccagcctggctgagagagcgagactccatctccaaaaaaaaaaaaaaaaaaaaaaaagaaagtatgatctctggccacaaggaattaaatgaggaattaataacagaaaggtatctggaagatctttcaaatatttggaaaataacataattttaagtaaatcatgggtcaaagaaaatcaacagcgaagtaagtaagtatctggaactgaatgaaggtgaaagtgccacataaaatttgtgtgatggagctaaagggaaatttatatagtgcagatggtccctgacttatgacgtctcaacttacatttttcaattttatgatgggtttttcaggatgtaacccaattttaagttgagcatctgtatcagaaaagaacaaaggtcccaaatcaatgaccttggggtcccacttttagaaattagaaaaaatgaagactagtgaaaccccaattaagcagaagaaaaagccagtgtggccaggcagggaggcccatgcctgtaatcccagcactttgggaggctgaggcgggcagatcacaaggtcaggagattgagatcatcccggccaacatggtgaaaccccgtctctactaaccatacaaaaattagctgggcgtggtggcgcttgcctgtgtaatcccagctactcaggaggctgaggcaggagaatcgctttaaccagggagtcggaggttgcagtgaaccgagatcgcgccattgcactccaccctagcgacagaacgagactccgtctcaaaaaaaaaagaaagaaagaaagaaaaagaaaaggccagtctggaaatcaatgaaacagaaaaccagtacagaaatcatgaaaccaaaagctagttatttgagagagcaatgaaactcataaacctctacccagactgatcaggggaaaaaagggaagacaataactgtaatatcagcagtgaaagagatgacatcacacagattctaaagatattgaaagtgtaataactgaatattgatcagcaatctagaagaaacagattccttgaatgacacaaactaccaaagttcactcaagaagtaaccatctgccgggcgcagtggcttacgcctgtaatcccagcactttggtaggccgaggtgggcggatcacgaggtcaggagaccgagaccatccttgctaacacggtgaaaccccgtctccactaaaaatacaaaaaattctccgggcgtggtggcgggcgcctgtagtcccagctactcaggaggctgaggcaggagaatggcttgaacctgggaggcggagcttgcagtgagccgagattgcaccactgcactccagcctgggtgacagagccagactctgtctcaaaaaaataaaataaaataaaaataaagtttagtaaaataaaaaaaatcagtaaaatacaaataaaatttagtaaaaataaagctgattctaaaatgcatgtgcaacagaggatctagagtagccaaaataagctcctctgtctgacttaaagtcttaattaaaataatcagacaggccgggcatggtggctcacgcctgtaatcccagcactttgggaggctgaggcaggtggatcacctgaggtcaggagttacaaaccagcctggccaacatggtgaaaccccatctctactaaaagtacaaaaattagtcaggcgtgatagcacacgcctgtaatcccagctactcaggaggctgaggcaggagaatcgcttgaacccgggaggcggaggttgcagtgagctgagatcatgccaccgcactccagcctgggcgacagagtgagactctcaaaataatgaaataaaaataaaaaactgaacttcatatcttgtccccagatctgatatagtcacttcttcctttgttcagttaaacccagcttcatgtttctgcttgcccagggccaataactttgggatcttccttgactcttctttttctgtcaaaccccgtaccagtctttcaggtaaccgtaacttcagagtctatccaggtcacctctgcttgtccaagcccctgtcatctctcacttggatgatttcattagcctcttggccagggtccctgcttctgctggtatttccttagtttcttctccctacagcagccagagctaatcattttaaatgtcatatttctgtctcgcctcagctgcaaaccttccagtaccttcccagctccttctaaataaacaccagaggccgggtgcagtggcttatgcctgtaatcccagcactttgggaggccaaggtgggcagatcacctgaggtcaggagttcgagaccagcctggccaacatggtgaaaccccctctctactaaaaatacaaaaattagctgggcgtgatggcgcctgtaatcccagctacttgggaggctgaggcaagagaatcgcctgaacccaggaggtggaggttgcagtgagccaagactgcgccactgcactccagcctgggcaacaagagtgagactctgtctcaaaaaatataaataaataaacaaacaagcaccagagccctggcagtcacctgtgaggcttcaccccgtctccccacccactataacctctgacttacctccttttacactccttcttgctgactctgttccttccacattggcctctttgctcttgcttgaatgatccccagtcatcctccctgcccagggcctttgcacttgctgttctctgccaggaaggtgcttcctccgtagttcactcttcacctcctttgggtctttgctcagttgtcatcttcagtgatggctcttctgatcaccttatttaatttttattttttaattaaaaattttttttgtggagatgtcttgctatgttgcccaggcttatctcaaactcctggactcaaacgatcctcctgcctcagcttcccaaagtgctgggattacaggtgtgagctaccacacccggccccgatcaccttatttaaaattgcagctcccagcccccaaccccagcatacccattcctctttttttttttttgagacagaatcttgctctgtctcaaattccctccagccatgagccctgaaatgaaacaagttatctatttccaaaacacaacagtggggcaggcataggatagacattcccattccaaaagggagcaataggcaagaagaaaggggtagctggtcccaagtaagtccaaaacctgagacagagtcttgctctatcgcccaggctggactgcagagtggtgcgatctcagctcactacaacctccgcctcccgggttcaagcgattctcctgcctcagcctcccaagtagctgggattagaggcatgcaccaccacacctggctaatttttgtagttttagtagaggcagggtttcaccatcttggccaggctggtctcaaactcctgaacctcaggtgattccccccgccttggcctcccaaagtgctgggattacaggcgtgagccaccgcctggtctccctcattccttttgttatcagtcatccctcccagccctggcaactgctgctcactttcctgaccttagaattttgcttattacagaatgtcatataagtagaattataaagtatctaagcttttaagtcctaatgcatttaagatctgtaaaaagtaaagtagaggttcctcttcaaagactttcctccccatctaattaggaataaatagtaacttctcttagaagaaaaatttattcaaagacctgtgctaacattcttaaatatctgctagccgtaataaagaaatcaatgtactttatattcttagctctcacaatttagcctaaatatttgccctggcatgcttatactggtccaagcaagcattaggtcatggcctgttcctcttccttatttgaaggtgtttttacctttctcagcactccacaagttacttcctccttcctttgttctcctctgcctttgcctcttttaaaaagttctaagttcctagccaatcaggacaaatacagaatgtgaggtcctgttccagccaatggaaactggacacagcagtagggtggacgcgtcaggttgtaaatgaccctgtctcctttgttcagtgtactctcatggcaaaactgctggtgagtgtaccctttctgcagaaagtaaaaaatggccttgctgaggaaattaaatttatgttcaagtgctttttcttcagggcaccagggaacaagcatttctaacagatccatatgtgtcgctgcatgtaatcagtggttcattcctttctattgctgagtagtgttccattgtatggatgtacccgtgtattgatccatccatccactgaaggatatttgagttgtttccagtttttttgtgattatgaataaagccactgtaagcattcacatagaggctttggtgtggacataagttttcatttctcttcggtaaataattaggagtagaattgctaggtcgtaggataagtatatgcttaacttaggagaccctgccacagtattttacaaagtaagggtgctattttgcattactaccagcagttcacaccatatgtattcacaccagttgctccatttggtcttcgttctgtgacttgtctctattctcttaacagtatctttagaacagcagaagtttttgattttgatgaaattcagtttatcgggccaggctgggtggcttatgcctataatcccagcactttgagagaccgaggagggtggatcacttgaggccaggagattgagaccagcttggccaacatggcgaaaccctgtctctactaaaaatataaaaattagccatacatcgtggcgcatgcctgtagttccagctactcaggagtctgaggcaggagaatcacttgaaccctggaggaagaggttgcagtgagctgagatcatactgctgcactccagcctgggcaacagagcaaaactccatttcaaaaaaaaataaaataaaatttcagtttatcagtgatttctcttaagtttcatgcattgggtattgtagctaagaaatcttcacctaactcaagtttacaaagattcttctgttttttttctagaagatttataagttttaatttaacttttaggcttataattcatttcacattaaatggtgtatgtggtgccaggtattgctcgagagtcatcatcttgcataggggtttcggatgttctagcaccatttgttcaacagatagcctcttttcattaaattgccctttcacctttgtggaagatcaattcagcatgcatgtatgggtcacttgtatgtttttaattgatttctaaattctgaaaggaaaatgataaaaaggaagattctttcactatatctgcatttccaatttctcccccaagaacgctttcctaacacctgcaggcagaactaaccactctgggcccctgtagctgttgtgcgtatgtttattattgagtttttctggcctttgcagttctttcagtgtctgattctccctctctctcagcttctttctcaagactgtgcatccttggaggtcagaaattgtctcatcctgccgggcgcgatggctcatgcctctaatcccagcactttgggaggccgaggcggttagatcacaaggtcaggagttcgagaccagcctggccaacatagtgaaaccctgtctctattaaaaatacaaaaattagctgagcgtggtggcacatgcctgtagtcccagctactcgggaggctgaggcaggagaatcgcttgaacccaggaggcggggaggttgtagtgagctgagattgtgccactgcactccagcctgggcaacagagcgagactccatctcaaaaataaataaataaataaaagacaaaataaattttctcatccttttttgtcatcttcatcacagctgcctctctaatgttcgttgaatgaaagggccattcccaaatctctgataagtcaagcatttttaggagagctaaaccagccaaatgagaccaggaagtgaagaaaaatacctttttttttttttttttttttttggagacggagcctcactttgtcacccaggccggagtgcagtggcacgatctgagctcactgcaacctccgcctcccaggttcaagcaattctattgcctcagcctccccagtagctgggactacgggcacacaccaccatgcccggctactttttttttgtatttttagtagagatggagtttcaccgtgctggccaggctggtgtcaaactcctgacctcgtgatccgcccgcctcagccttccaaagtgctgggattacacgcgtgagccaccgcgcccagctgaaaaatacctactttttttttttttttacagcaggaggtgtttctgcttctactttgctgtgacttctgtttctccaggcattcctggtatggacatttataccaggtgttttggtcattggtgggctctcagcttcagaggacacttggcttctctataccctatctttggtgacttctgcttgttggacttcagtcactgcagttcacaagtttcacactcatgaaatatttattgttaattaattccaatatttaattgattgcttctctttctcagcactttggaaacatgtttactacctagacattttcctacagtagatttttaattcttaacattttgatcttaagcaatttaccatgatacttggtttccatgagagatttaacagttggaactgtactgcccataagatgcaggtggggtcatggtatgtagttgggaactctacaaatggcagcccttcatgcctttgcaaaggctgcaggttggaaagctgccattacttgtgagggcgtccaaatgcttcctgtgaatggaagatgtgtttctgtgcctcactgtcttcactgtgctggattgctggctttctcagatgtctttatttgagtcaacctgtattccatctccccactcccacccagtcttgatcatctcatttgtgtgtatacaaccttcccctcacacacacctctttgcagagtttcgttgcactgggcgttgggaggagaggcgtcagagttgggtggaatcatttcaggctgactgtccagacatagctctcattagaagcatcagtaaataagctgaaaaccaacaacacgtacagcacagtctttctgtgtttgcagcttggaactgagcagccctcactgggtgcatttctaatcctttgtctcatcatttatatgacatccacttagaaaaaggtgttaaaatcatataacatattgctttttccccttttttattagcagttttactgaggtgtaatttatatgccataaaatttaccatttgaatgttcaattcaatgatttctactaaatttatagagtgtgcaccataaccacaatccagttttattttttatttttttttcgagacagagtctcactctgtcactcaagctggagtgcagtggtgcaatctcggctcactgcagcctccacctcccgggttcaagcgattctcctgcctcagcctcccgagtatctgggactacaggcacgtgccaccatgcccagctaagttttttgtattcttagtagagatagggtttcaccatgttagccaggatggtctcgatctcctgacctcatgatccgccagcctcagcctcccaaagtgctgggattacaggcgtgagccaccgcacctggccccacaatccagttttagaacatttccagcatccccaaaagatcccttttgtccctttgcagcagtcctacccccacttccagccccaggcgaccattcatttgctttttctatagatttgtcttttccgtacgtttcatgtaaatgaagttttatacaatatatgaccttttgtgactgttttttttcccagcatgtttttgaggtttatctgtattatagcacgtctcagtactttgttccctttttatcactgagtattattccattgtacggacatacatttttctctattcactagttggtgaacatttggattgtttccagttttggtcatcattaacaatgctactatatatatccatgtataagtctttgtgtggatatacattttcatttctctagggtagatttctagaagtaaaattgctgagtctttttttttttttttgagatggagttttgctcttgttgcctgggctggagtgcaatggcataatcttggctcactgcaacttccgcctccctggttcaagtgattctcctgcctcagcctcccgggtagctgggattacaggcatgtgctaccacacctggctattattattattattttttttttttttttttgagacagagtctcgctctgtcacccaggctggagtgcagtgcgcgatctcagctcactgcaagctctgcctcccgggttcatgccattctcccgcctcagcctcccaagtactgggactacaggcacccaccaccacccccggctaattttttgtatttttagtagagacgaggtttcactgtgttagccgggatgctctcactctcctgacctcgtgatctgcctgcctcggcctcccaaagtgctggcattacaggcgtgagccaccatgcctggcaaattttgtatttttagtagagacgaggtttcaccatgttgatcaggctggtctcaaactcctgacctcaggtgatccacccaccttggcctcccaaagtgttgggattacaggcgtgagccaccacgaccggtcaaattgctgtcttatagtaagtttatgtttaactttttaagaaactgccaaactatttcctaaagtgactgtaccatttacattcccaccagcaatgtgtgagtgttccagtttttccatgtccttgccaatagttggttttgtctgcctacctatccccgcccctgcttttttttttttttttttttttttaagagacagggtcttgctgtgttgttcaggctggcctcaaactcctgggctcaagtgctcctccctagtagctgggactataggcacacaccagtgtaccaggggttgtctgtcttttgattatagctattggaatgggtgtgaagcagcatctcgtgattttagtttccatttcttgaatgactaatgatactgaacatctttttatgtgcttattagccatttgtatttcatctttggtgacctgtcaattcaaatcttttgcctatttttttttattaagtttgtgcactgtcttattatcgagtggtaagagttctctgtattgtgggtacaagttcttttttttttcgagatggagtctcgctctgtcacccagggtggagtacagtggcacgatctcagctcactacaacctctgcctcctgggttcaagcgattcttctgcctcagcatcccaagtagctgggactacaggcttgcaccaccacacccagctaatttttgaatttttagtagagacgggatttcaccatcttggccagacgggtctcaaactactgacctcgtgatcctcccacctcggcctcccaaagtgctgggattacaggtgtgagccaccgtgcccggccttccaagttctttatcaggtatatgatagcacatgtagctttttatcttccttacaccagtgcaagtttatagaaaggaaaagggatagttaatagtaatcataataatgtttaatatttgaatgttttttaggagctggacactgggctgcatgtttcacggggatgatttgggtcactcttcaattttctaaaggttacaggactgtttcaaacacctctccttctattaacagttttcaatggagaaagaaaacaaaagattgatttggggaattcttaggttaatgcgagttagaactgaccttttaacattattaccataaggactaaatggctgttacagacccaaaataggagcaattcaaacaagcgagatgcttctctctgtaacaggctgacagtcgcggtcctggaggggcacgatggctcctcagggtcagacacctcctgtcccttactctgtaaggcacagcttctacctcaggatccaaaatgcccacgccagctgccatggcccctcacaggcagtggacaccagaaagaggagagggagtgcgtgcctgttgctttgaagaacctgacccagaagtcttacacagcacttttgcccacataccatcacttagtcatgtggtagtgcctggccacaagagagactgggaaatggagtctttattctggggtgatgtgtcccatctgcaactgaggggttaaggcctaaaacttagggattgaaggcaggagaaaaaacagatgtcgagagccagtgttgggattgcagggtcctgtgtgggattcctgttcattttcatcaaagaaagtctagttgatatgcaattgttggcctaagtgttattgaggagttaattttactgttgaattacaccagaacatttgtcatgtgaaataactataaatacgactgattattgcctagtgtattacagttctctccagagacacaggaaacaatagggtctgtctatcggaatagatatcctaaaagtgtatcttttgaagagattgattataaggtattggctcatgagatgatggagcttaagaagtcccacagtctgctctctgccagatggagacccaggaaagctgctggtgtagtttgaaggcctgagagctgagggccagtgatgtggattccagtctgaaggtctgagaacccagagggctgagggcaggagaagatccatgtcccagctcaagcaggcagagggagggtaaatccaaccttcctttttctgtttttttgttctaatcaggccctcaacggactggaggatgcccagccaaagtggggagggccatctgcttaggcagttcaccaattcaaatgctagtctcttctagaaacaccctcacagacacacctggaaataatgtttaagatctgggcatcctgggggtctagtcaagctgacacatacatttaaccaccacacttagggaatatgaaaataacttagacattaaatttgattttggtgttgctgtaaagaatacagatcttaggcaccagctcgtaggaggggtggtaaacaaggaggacagcttttaccaggttgcctttggaagcaaaactctgctttgctgttttgttttcaagcggctgcatggccactgagcgagccctttcctgccatcaccacagtgccacttagtgaacagtttctccaaggttaactgtagctgctcttgttcagttaatatgtagttctggattaatatgccacatctgtcactttaaggaagaaaaagagcagttccgtttagagatcccattgctcctctaaggacagcagtcatttctaacaagcagagggaagaaatcttctggttccatttgtcctttgtgtgtgttgaaaaccttgacaacaaaacaaattggtactgaatggtttgaagaaataaacattaactcccctttagtatttcatttctagggtttccagccttggtaacaattaccaagaactttgctgtcatggggtacagctctaggctgctgacaggatcttcatactggaggagactatacttttatagccaattccaactgccccagagataacttggataaacactggctcctccactacctcctaatccctgctgggttttacactgtggggaggtttagacaacttgttttctttcccttttagcccttctctctacactcccctccagctgccttcttcccccacccccaaatgtaacgtgatctcctaggcctgctctgctgcttttgcagattcttttagtcttagagaaagagaggaaaatattaaccattggtttaccaattcaaagttaacaacattttaaacaaaaggagcttgtcaataaccagggcttgggcttttcttttatcagttcctcctacttggctgagtttacctcatcataaatcttatcacacagataataatttgacagctttagggtttttgcagcattgctattttctattgcaacaaagctgtaacattgctatttttgatgtatttgttttatagatatcttaatcttcaatattcagattaaaaacaaacaagacttagtgatttaaaattatttggtaaaaaggtaaagggacagagacatctcatgaaaacatggcaaaatctctttaagtttaattcaagcacttagagtttaataagaatatcccaaaccatttttgcttaataatatttctgtttataattaaaccttaaggtacagtgttgtaactggatttaagaatttagagttttgttgtttcttcgccatcagcgaaattaagatttaaaacctatagtttgcaacaaattttagtttttcagcctagtgtcctaaaacttgtctgtcatgggtacctagtaggtgtcatgtcacaggaaagggatctaacaagggagtttgaagataggggttttccttgctctgccactaacttgctatgtgacctagggcaagttatataacctatctgtgtcacagttgtctgaaatgcaatatggggaaaataaattcttaaaatgacaataaaaagatttcttttttttttttgagacagagtcggcgcaatttcggctcactgcaacctccacctcctgggttcaggcgattctcctgtctgagcctcctgagtagctgggattacaggcacacaccaccacgcccagcaaatttttgtgtattttgtagagatggggtttcgccatgttggccaggctggtctcaaactcttgagctcaaacgatctacctgccttggcctcccaaagtgctgggattacaggcatgagccaccacgcctggccaaaatatatatatacatattttaagtgaagatgtgtaaggactaaaggagcccaaaggagacagtaggggataagaaaggcaaagagagtggtaatagatttagcagaatcaaggatgccaaaacctcttctgagagagaccttgattaagagtgagctggtttgcctgtaagaatctgcggaaaggtcagaaattagagacattagtaccacagaaagcaggggatgaggcctgaagctgaaatcaaggggatcaattgagagcctataaaaggagggtttagattcttcaaacccctcccaaccccacagagtcagatgaccacctctcctaaccacctacaggagaccagaggcattatattgagaaatgcccggccgggcgcggtggctcacgcctgtaatcccagcactttgggaggccgaggcgggcggatcacaaggtcaggagatcgagaccatcctggctaatgtggtgaaacaccatctctactaaaaatacaaaaaattagccgggcgtggtggcgggcgcctgtagtcccagctactcaggaggctgaggcaggagaatggcgtgaaccctgaaggcggagcttgcagtgagccgagatggcgccactgcactccagcctgggcaacagagcaagactccgcctcagaaaaaaaaaagaaaagaaatgccccgtagaggctctgcactcaggagcctgacccccagcatgggtccgggtaggccattggccgaaaatagtggagtgggcaaagagcagattttttaaaagtctgcatactgaatagtaagattcccagccctcttctaatacctgctagccaggggcctaataaggaagagattgaaatattcttttctagggggaaaaagttgaatgaccctagagaaaagccctacagataccaacatttagggattctcttgaaaaagcgagtttaccatctcctttcactgaagcttaccagtggctgtgccccttccacgcatacaaaactaacagtcatcttttagttgctcattcatagagagtgagtggcctgccaaatctctctaggcattagaggaaggtctctaacctgatattaatagataaagggtaaaacaaatagcagaaaacaggaacttggtggaaataaagacaatgcagtcaacagaggaagagtttaaaagaactattcagcttgggcaccatgactcacgcctgtaatcccaacactttgggaggctgaggtggacagttcacctgcggtcaggagtttgagaccagcttggccaacatagtgaaaccccatctccactaaaaatacaaaaattaactgaacatggtggcaggcacctgtaatcccagctattgggaggctgaggcaggagaattgcttgaacctgggaggcatagcttgcagtgagccaagattgcaccaccgcattccagcctgggtgacagagtgagactctgtctcaaaaataataaataaataaataaataaataaataaataaataaagctatgcatttcccacaaatactgcttaaaaaaaaaagaactattctttgctatccttggagagagagattgcaaatgtcagaaaacaggatgcttttaaaaacaataacaatcagaataagaataaaaatgaattatttttcttttatttatttatttatttatttttgatacatggtctctgtcacccaggctggagtgcagtggcaagatcacagctcactgcagccccaacctgcctcagccccccaagcaactgggactacaggcacgcaccaccacacctggctaatttttaaattttttgtagagagatggggtctcactatgttgcccaggctggtcttgaactcctgggctcaagtgatcctcctgcctcagcctccccccaaagggctgggattataggcatgagccaccacacccagcaagaatgaattgtttaatattaaaaacattatagcccaaatttaaaatccaacagaagatgtggaaaattgtctcagaatgtattgggttggtacaaaagtaattggggcttttgccattttaatgacaaaaacgttgattacttttacaccaacctaatagaacataaagacaaagacatggactgttgagagaacaataagagagaacaggtaagaaaattagaaactctcgggaggctgagacaggataatcgcttgaacccaggaggcagaagttgtagtgagccgagactgtgccattgcactcctgcctgggcaagcaacaagagtgaaactgcgtctcaaaaaaaaagaaaagaaaattagaaactcaatcccagggctttaatatcctttttgtaggaattccagaaagaaaacaaaaaaataatgataataacgaagaaacaaatggaggagaagttaggagacgttaaatgtaaggaaaaatttcagagtttagtgaagtgagtattttccaaaacagaattatataaatctctggatttatgagtgcccagaataatatatgaaaggccatatcattgtgaaagttcagaacaccaagaatattagaagatcctaaaagtttccaaagagaaaaaaagcaagtcattttaaggggtcaggaaccagaatgggattgcatctctaaacaatacttactggaaactagatagtagcagataaataaatgccttcaaagttcatttgggaaaattattttcaacctagaattctatacccagacaaactgtcaagatagaagaaaggtatttttttagacatgcaccctccctccccacctctgtgaagctactggatgatgaattccagcaaaatgaagaagtcagtcaataagtagaactgagcccgggcacggtggctcacacctgtaatcgcagcactttgggaggccgaggcgggcagatcacgaggtcaggagattgagaccatcctggtgtaacacagtgaaaccccgtctctactaaaaatacaaaaaaattagcagggcgtggtggcggtcccctgtagtccgagctactcgggaggctgaggcaggagaatggcgtggtgaacccgggaggcggagcttgcagtgggcggagatcgcgccactgcactcccgcctgggtgacagagcgagactacgtctcaaaaaaaaaaaaaaaaaaaaagtacaactgagaatatttgaaatgttttagtgattggaaaaaatatcactagatgtttgacagatctttgaagtatttgagggaaaatggtgataggtatatagaagactaaatgaaaacaaggcaatatctctaggataaacaaagatgtataataaaggaaacattcatagtatattattggctaagcagtgaagaatatttatatcatcctaataatgtaaacactaactattgatttatcccccaaattgtgattttattgttttggggggttatggatggtgatagtataatactgctgtcataagttaatagataatggataaatctaatgaattcagaaagagcaagatgatgttactagctaaaaatctgaaggaggctgtctctgcggaaacatacaggggaaagggattgctgttttttattaccagatttttacaagactatttttagccttttttacaagacttttagtactgcttgagttttaaccatgttatgtatattactttgattaaaaagaaaaattaatttaaaaaaatgagcatactaataccattaattttctccttctagagaaaaatgtttaacagttaggtttagacttgttaattataaaaatatagtagtcttactgtaatgagattttctagaaagcggatttactctaaggcagttcagatttggtccccagctgagaattatagcctggaaataccaacagaaaaatcagtgtcatttgaaggacagtcatctgtgcagcctgtgcatgaaatcatgggtctgaattaggcccccattcaagatgcgggggtgtggggtttgtgttttgctgaagctgtggttgcaaatctttgctttaggatgaaaggtggggctctctgttacatttgaaccttagttgctactcctacctcacagctagtgtttctttctcttcataaaataaattgatttcctggtcccttggaaaacctccagactgctttctggaatcattttcatatagcatgtttgttaatttgagctcttgactgagtcccagtgagatgtaggcaggaacacagacctgatacagaaatagtcctcttttggaaataacaatagctactgtttatcgagcaccttctgtgctttgggcactctccctacatgattcctaatcttcataataaccctgtgagataactactcttatgactacctcccatttttcagatgagaaaattgaggctctgagaggtgaagtcgttgcccatggccccacagtgagtggcagatctgagactcagcgctagcctttgtgacacataactcgtgaccagcaggtagtgctacccgattgaaaaaatgtgagacttaaagggatgcatgtgtccctatacagtggcaaaaactggtatgacagaagtgatgttttaagctatgttatcctttagttggacatacactggacccacagagctagagtacctggcaggctcttgctggacaatgtttgctgaatcagagaaagtgggctttgttggcatttgcatgtgaaatactgtgcacatacctcaagatctttgctgttccccccctaaagctactagctatgctggaaacagtgaaggggtcagccagacctggggtcaccttgtcctggggtcccaagccaggcctcctgtcaggttcatctgtctctgttccacctgcactcacacccagtcttgctgctgagagatggagcatccacatcctgaatcctgcctccttcccttgacacacttctatggtgggtgcctgcccaactttttcttaataggactaaattccaaattaaaaaaaaaattcagtctctctcctctaatcatccaagaagagtcctcttttggtaacttgttctagaactatgcctatcttaaattcagaaattgctttcaaatgaattaaattttagaaatatccattcctgttcgtcctattcccagtgaaaataagcaactcttccctcttccaaaacagtggatttcttttctttttttctttttttgaaatgtagtcttgctctgctgcccaggctggagtgcagtggtgcaatcttggcacactgcaacctccacctcccaggttcaagcgattctcctgcctcagcctctcgagtagctgggattacaggtgtgtaccaccatgcctggctaatttttgtatttttagtagagacaggatttccccatgttggccaggctggtctttaactcctgacctcaggtgatcgcccaccttagcctcccaaagtgctgggattacaggcgtgagctactgtgtctggcccccaaacagtggatttccatcttacatatgcatacagatcatctgggagcttcagatccagcccattacacatattctgattctagactagaaaccaagactccgcattttaagcaagccccacattattcaaaatagattgtccatggattatgcttttagaaacattgttcagatcccatgctttaatgttggggagtttatcctttccttctaaatattttttttttttttgagatggagtctcgctctgttgcccaggctggagtgtggtggtgcgatcactgctcactgcatcctccacctcccaggttcaagcaattctctgcctcagcctcccgagtagctgggattacagatgcccgctaccacgcccagctaatttttttgtacttttagtagagatggggtttcaccatctcaaaaaaaaaaaaaatcttaaatagctctagttccctgaattattttctcctaagacatgttttcccaacagttaatgttacttatttcatcttctgatcttactcatattatccacctttcacttaaattggaaattttctgccattttacaaagttcaagactttcctaccttcctacctcctggctgtgtgaacttggacagaatacttccccctctccctccagtcagttttcttacttgtgaaatggaattaaactatacaaaatcattaggttactgtgaggcttaagagtgcctggcacatattacatgcacattaaaaatgtatttcttcccaaactaatgcaacatagcaaacaagttagttcacagtctttaatttctttccttttccctttctttttagctaatagcttttgggtcttaggctgattagaaggaatccttcttggggtgttcttctggtaagaagattgaagctctcctttatttgcttgtaacagaatgctcttcgtatctttcaaaagcgtcaaaagctggatatggaaagtataggccaggtttgatacagaagtgtagtttggcagttttttcagtatccattgccactaattcagtattttgttagatctgttgatgtatggttttataactaaaattaaaaagatttgggtacagtttataagcattattcattttaagaggatttaagaggataagatcattttagactcaagagcagaatattagtaataataattagcttaaaaaaataaacatataccaatataaagaacagcacaaggcaagcaaatatctgggcctatattaacagacggtattcaaggatatggctagaatttccaaaatgcctaataatgtgtaattcttggcattaagccgccaatttgaatatggccctttaatatgaaatgctatataatgacagactttattatagtctgatccaaggcccctgaactttccaaaagggcaacaaaacagacagatactgtattttttcactagttggtactggtggcacccttttgagtgttatttttggcattacgtgtagaggttgacagattcaagacaacactaaacatgttagcagtcaccacacgcaggctgtccagcagaatgacagcgcttcccagatcctagaaagcatccagagtcactgcacccatcccctgggggccctgtagtcctgcatctccagatgatgggagctgcaaacttccctgatggtgccctcttggatgctcatgaggcctgatctggtaccacgactctagcagtaggtccattcaatggcagtaaaaatacatgttgtatgttgatcagaatttggcaggacacatgtggaaagttaatgacatcctggccgagaacccctgtgatatacactggttacatcctgtccaactggagtttttatgtgctgtttttggcagagccaagtgaagatcttgttacttagccattcctgaggtactgaagatacccgggtttttgtcattacaggataggctagaaagtagccagggtctcataaccaaggctttctctgaaacatataatgacaatgctagttatttgaccaaagatatccaatgctttaatccacttggaatttattcttgatgtgaagggtcagcatcatccactggtcgggagcctgatccttggagccaggcagacctgggttgagtccatctccgcctgtttccagctgtgggcaaggtgtctgacttctctgagcatctgtggggtttgtttgtttttaaacctgaagaattgggataatctgtttcctcacagaatcattacgcagatgcaatacagttaatgaaggtaacatggcacataggaagagcacaatacacgtcagctcttactcttcatggctagaagatgtggactaaacttccccctttacagttttgtgattaacaccatttatgaaagaaataaatgaaataaattccttttcctgtcatgaggggaacttacctgattttattgaattatttggtgccattgagttccttattgtttccctctgacctagatttctgggtgtgcgccagtaacacgactgtgattgttgctgctttataacattgtctgtggtcagtccaaacaagagtttaaaataattgaatgaaatggattttaaacaatggtccccccaccctcaccccgtggcactcggccaaaggaagaggaaaagttctctgttaaagaaaatgaatcagagaagaggcccagaccgtgcctccgaaaattctcattgtagggactaagtcctctcactctgaactcacacccgtctgttcgcagcctgacctcatatcctggtctggatgtgcggcctcaccggggtgtcgtgcgcacgtgtggttgtcctgtgggtgccagctctgacttcctccccagacacccactgcctcagccttaatcacaggacgcgcgttgagtagaaatgagaccagttagtattggtaactgcagaggaatatgcattttcaccagcgttctcgggtcagagggtttgcctggcaccgcgtactgggaaactcgccaaaagcggtgcaggttggagacgccccaggccgcggtggagttgcgcgcggcttctaaagtggagtggagcaggcctgcaccctccccgccggggctgggacggcgcttccaggcggagaaagacctccgcgggccgcgcgcggccttccccctgcgaggatcgccattggcccgggttggctttggaaagcggcggtggctttgggccgggctcggcctcgggaacgccaggggcccctgggtgcggacgggcgcggccaggagggggttaaggcgcaggcggcggcggggcgggggcgggcctggcgggcgccctctccgggccctttgttaacaggcgcgtcccggccaggcggagacgcggccgcggccatgggcgggcgcgggcgcgcggggcggcggtgagggcggctggcggggccgggggcgccgggggggcgcgcgggccgagccgggcctgagccgggcccgcggaccgagctgggagaggggttccggcccccgacgtgctggcgcgggaaaatgttggagatctgcctgaagctggtgggctgcaaatccaagaaggggctgtcctcgtcctccagctgttatctggaaggtaagcccgggccgcacgggttgggctgagtagccgcgcgccctcccgctgctgctgggcccttcctaggcctcgccgcccgcgcgctcccgcctgcgccctccccgggtcttgtcttttttttctttcttccctcttctcttctcttctcttcagttctcttatattctgtctctctttctttctctctgtgtctgtctcttttctcttctcttgtctctctctttttctctctctctgtctctttctctttctcgcgatggcccctaggcgccgccggcggagcgtggcccccagccccggcaccagccccggtagagccacgccggatggtgacggcggcgtccggggccccacagtgcgggctcccccgaaaaagtttgagaaagccaactcgccaggccttaacatccctgggatcccacgttgtggaatttccaccgttaattgggactgtgtgttaaaaagatcgacccgtgtttgtgaaaacatgcgatttccattaagcatcatgtacacaaggagcaccactctaccatttatggatacagaatttcaagtgatctttccatctcccccacccccatcttatctacagaccacgaagaggtcttaggaattcgctctcttttcaggggaggggagcccatttaagaaggcgtttccaaggagtcccccagagtactggggtgtcatgttcgtttccttaagtgaagctcagggccaggagggcttcacttttgcgttctttctacctactctccttctctaattacatctgttttattttatttttctttcctgttgtagtctttagttttataaatggaaaaaaagtaaattaagggttatgggtcttcactttcgtagcttctaggtgggtatgaaattgatctgatttgagactggtgctcccagaccattgccttcagcagaaaggctatctgtgcttcagagatggagtggcacttggacttctctgttgttttcaactaagaatataagagtaaaaatgtggccgggcgcggtggctcaagcctgtaatcccaacactttgggaggccgagacgggtggattatttgaggtcaggatttcgagaccagcctggccaacatggtgaaaccctatttctactaaaaatacaaaaaattagccgggcgtggtggtacacgcctgtaatcccagctactcgggaggctgaggcaggagaattgcttgaacccggcagggggaggttgcagtgagccaagatcgcgccactgcactccagcctgggcgacacagcaagactcggtctcaaaaaaaaaaaaaaaaaaaaaagagtagaaagaaatgtgaagctcactttagatcaagtaggatttctgctagaatgccatgtttttctttttaaaaaagcaggagaaataaacaggcctcatttattttctaacctatttttctttccttaacctctgactctaccctgaaggcctgcttggagtcacatatgcagatcgcactagtgatgtgggtgaaacctgtttgcccttcttgccacagtttgtgtacctcactcctcttctgtctctgggattccagggggctgaatggcccagagaaggctcatctaggtggagtgggctcacagagcctagcatttggagggtggagattgtttatttgtccctaaaagttgatgtctgagcattccaaatcatcttcaattaatacatcgcttattttttccaagttgctcaaaattctgagcacattctcatttacatctgtatcgagttagtgttaggcatcatcatctccactttgcagatgggtgcctaaggcggggatgaatggacttttgtaagtgcagagctggagcaaagtttaggtcacagctttgccaagtcattgttttgttttcctgggagtaaaccggagatttagtatggacctggctggtttaattattgttttgggaaaaaaatctaaaactcattccaacatgtcttgaaatgaattataatgttgactctaaagtctcaaaaaaaaaaaaaagttctagtacagcagactgccttgggttaaaccttcttctaggaaggtgtcactctaggaattctttcttactgagttttcttcttttcgttgttatagttaattagagaaagtaaatggaattatcattttgtagttggtagactttaacaagcctcagcgatagtcttttaaagactggaagtgctatttgtcttttgggaaaaatagttcctaacatctggatgagtaatccaggctttccactttcactgacagcctaaatcagtcaatcagtgtcgatcagtcagtcagtgtttattgacgcccactcagggtcccaggcattccctgtcagggagagaattgaatgagatcaagtttttcattgttctatcaaagaagcttccaccataaatgtggtttgatggtgcatgctacctgctactcagcctagctgtcaaagcaacactggtaaacataaagatggctagcaattattaaatgcttactatgtgccaaatactgttttattactctatgtgatctgatatagttatatttcatgatagcactatgattatttccattttatagatgaggaaactgagtcaccaaaaggttaggtaacttgtctagggtcacagagccagtgagtgggggtactggaatttgaactcatgctatctggcttgggagagcccacttttagccactggatgctctactgatgtctcttttggaattcactgtgattttcaaaatggtatctccagaaactcctccaattaatccctgaaatgtaagggtagtctctttttcttttctagaaacctgatcctggcaaaatgattagctttaacagtaggattaattttttttaaatgtatataaaaatacttgtatgtaagaaatcctaaaagggtatttagtgaaaagtaattccctctcctattcattttccccacctagaggcaatcaccctggagttttatgtgtgtccttctagaaatactgtgtgcacatataagcatttattataacatgtgaattttgctctccagctttttgtgaatatgcatgtttatagcagtatctattcaccaggaccgcatttagctttgcaatattcggtctactttgaacactgaattttctgattatttctttcccctggagacgtcaaagaaaacatgaacactagccttttgaattcagggttttcttttcattttattttcatttgttcatgtgtttgtatttacatacattgtgcctgaatattgtacatgtatgtgacagttgtgtactgtagaatcaaaaactaatgtctgtgaactgaactcttcttgaactttttgttgttgttgttattgttgcttttggagatagggtcttgctctgtcacccaggctggactgcagtggcacaatcacagctcactgcagccttgagctcctggtctcaagcaaccctcccacctcagcctcccaagtagctggggctgcaggcatatgctacctgactaattaaaattttttttttttttttgtagagacagggtctcactatttttactagtttgcccgggccaagccagtgttgaactactggcctcaagtgatcctcccaccttggcctccccaaagtgcatccctacaggcatgagccactgcactcagcctgaactttcgaaatttattttaagggcccacttttaaatgcttcttttcagcagctaactttccagcggatgcttcatgtggtgccagccatacagatacgcttttagaacttgagctttggagaagcttatgcttgctttctgctctctcctgaggtcatcagatacttcccttgttcagtaacaaagaaagtgagactctttctgttacctaataaaaggccagtctgtccatttcattttgggtgctattaacattgttgaccatttacaatgtcacaggccctggcactgagcacatcatgtgcagcctcacttaattttcacaccagtgccctgaggtttctagaaaagaggaagggccccagtttaggtggcagtacttttcaatttggaggcaggagatcccagttttcctctgacctctctgagcttccgtgtttttacctctaagacagagagaccaatctctgttcagccaccttagaggattgttttgagggtctataagatgattgagggaaagctctgaaactggtaagagttaaatgtatgtttgtgttatgttgatacgagattcctctgagatgctctttagtccaggcaggtttatggctcacacagcgttcctagggtctcattcttctgcacaggcaggcagctcccgagccagccagtctggacccaaatgccacctgtgctcttggctggtcttgcgcattcaccgaggctcactgtaccttggtgttcccatttctaaaataaggcctgtagtaatccctacctcactgagttgttgagagacttcatgtaaattgtttagcagggagcctggcacagaacaagagcctagcagaaaagtaagctgttgttactttaagcaaatatttagcagcctaaaatggtggctttaccagtttctgtaatggttgaagtgatgacagaattcagccaatcccacccatagtttttcttgctaataaagcagtttgtttctaagtgtgttttgatgcgtataattaatacttcctgtccttgatttttggctgaaaaatgtcttctcttcctcgcaccctctgttattcccgtagtgaatattttcattgtggaagagaaattcccattggctcatggttggcattttatttctcctgtccagagacaatatttccacagcctcaaacgtgaaaactgaaaatctggtgccacttaccaccttgtaaaatcaagtcattgtaattgtgccagtataatcattgatctgaaataaaagcagaaaataaatcaatgggtagctttcttaaatacataagaactaaagatcaaatgggatattggaagactttaacttttcctccataatggtggatcttaattaaacacacagaagaacaatttataaaataaattcataggtttgtttgttcttttttagtgtcaatttttaaaactatctcttttttaattaaaaaaaatagagatgggtctcactatgtcgcccaggctggtctcaaactcctgggctcaagcaatcctcccacctcagcctcccaaagtgctgggattacaggcatgagccactgcacccagcctaaaactgtctcaaaagtagacagcataatgaactcccatgtacttatgatgtggctttaacaattatcagcttatagtcagtcttgttttcttacataataaagttacagtttcaaagccattaggaagaatagcttgctaattataattacttagttttgatagtgtaactttgtcctcagatgggtagaatcgttactctggaacaggggtgtccaatcttggcttccctgggccacattgggagaaaaattgtcttgggccacacgtaaaacatactaacgatagctgatgagctaaaccaacaaaacaaatcccacaaaaatctcatttctttttttttttgagacaagagtctcactctgtcgcccagactggagtgcagttgcacgatctcagctcactgcaagctccgcctcctgggttcacgccattctcctgcctcagcctccctagtagagggtactacaggcgcccgggggtttcaccatgttagccaggatggtctccatctcctgacctcgtgatccgcccacctcggcctcccaaagccctgggattacaggcgtgagccactgcaccgggccaaaaatcttataatgtttttaagaaagtttgcaaatttgttaggccacattcaaagccgtcctgggccatatgcagcccgtgggccatgggttgaacaagcttgctctagaaattggttttcaggccgggcgcggtggctgacgcctgtaatcccagcactttgggaggccgaggcaggtggtcacctgaggtcaggagttcgagaccagcctggccaacatgctgaaaccctgtctctactaaaaatataaaaaattagccaggcgtagtggggagtgcctgtaatcccagctactcaggaggctaaggcaggagaattacttgaacctgggaggcagaggttgcagtgagccgcgatctcaccattgtactccagcctgggcaacgagcaaaaactccagctcaaaaaaaaaagttggttttcaaatccttctttctttaccatgttacaccataaatatttttgttatattgcgtgtgttgagtactggtgatagggaagacagagagaaataggtgggaaggagatagagagagagagagggagggaggaaggggagacataagggggaaatctatagagacagagactgagagacaaatacaaaaaggttgagacaggaaagggaaaaaaaaacaagctgggagggaaggaagactgagagaagggagacaaagaggaataggatggccagtggggctggggtgggtgggtacagagagagaatgagtgagagcaagagaagcgcaggagacagatgatggacaggcagctgatgtatggatgggtagctggagagagaggccatcagtaacttcacatctctctgtttccatttcctgccctcaaatgccttcataatagagtctacgtaataaggttatagggattcagtgcagatgaagtgctggcacttgatacgggatcagtaagtattagctattattctatcacattaagttgcataaactttaacctcattactcttaaattctctatagaaacctagtctttatctgtcttacaagccctcaaatttagctaatagcgttgttcattgaataccttaaaattgtatttaaagacaggccgtgaatacaattaggcattgctttttgaagccaaaataccatgagggtggggagggtcatgttcatttacccagatcagcaataaaaatactaatggctaacaaggctttctggggaaattgcctgtcattgggtagcccagtgcctctggtgtcagctgaccccggagtccatgaagacatgttaaaagaagaggaaatgtgaatgctttcaaaccagccatggctggcagcagaaggggaggcctttcagtctgttgcaaatggcctgtgacaataaaaatgcctttgtgggtattagcaggctgactgtggacagtctggatctgcggccactgcagggattcctggaacctgttgggaaggtgtccggcgagctcactgtggtgtctgttaggaatctggagcaaatcctatttcttttgaaagcacagagaactgtgtttttacattatacctttaggattttggccatggtttatatttcagtcaaaacaaatcattatgttccctaggcttttatataggttttcctggtcaggttgcatttgtttttcaactttactatctgtcattattgctgctcttattacaggttaacagattattaaactgcacttttcagtaccttgtagctaaagacagacaagtgcagggtgttccacatctgagttcacccagcagtgctgtgttgttgcgttgcactgagcaggcacagaaggctctgagatatgagagacttggtctctaccccagaggagtttacattgttgtggtggcagaagagaaggcgtggcataagagaagacgcggttgttctgtagtgagcatcccagtgtcaggtgccacagttggcatccatgcagaaattctctgcatgcaggattcattgagccctcccgacagcccaactaggttgatgccatgccgttgttgccctgttgtgcagttgagaaactgaggctcagaaacaaatgtcttcaagacatgctggtgctgaggtttgaacaaggcctgtccacccagagcccatgctttttgtactgctggggacatgtgaacagattgcttactgggtgatagatgcagggtggtgatagagacagacaccaggtacccaaatgggttaaaggagaagcatcctgttgtgggcgaggtgatggggaggaggaaggaccggttagagaaggtttatgggagatggggaggccaggaagagcagaagaggctggggaacgaactctagggagagtaaatggcacttgtcacagtgcagtcaggagaggcaagcaacaggaggcctgggggatctgaaaggagtttggagaggctggaatggaaagcaggagtagagggccagatgctcccagtctcaaccctgaagagcctggcatgcctgcttcaggagctcagacttttactatagtggtggaaggaataacaaccccagccattttttgagggcctgtgcatgcctaggccctcaaaaacatgtcccatgttagctgcaaactgccagctaccctgcaaagcacatcatgatcccagcattgcccccgatgacactgccagtaagtggtagctgaccattgggagacagggccacctcccaagcccatgctctcttctgcctctcggctggcagccatctctaagggatttgaagcaagagagtgacctggtcaggtctgcatttgagaaagatggccctgatagtagggagtggaggtggaatggccaaagggggacccagccaagggcgtggtagagcatggaaaggacagaagtgatgagagattgaggaggaaaagtgccaagatgcagggtgggaactgacagaggatgacttccagcctcagtcctgatatgggcgtcaatggcaggtgttcagaatggccttgaagatagtggcatctctatttatgagtgtctttgtactccatttccagtaattggagactttttcaccgtagattcttggaaggtgacacaattttttttttttcctttttggttgagggagggggacagggactgtgtatcttcagaaaggttaatatttgaggccaaggcaggcagatcacttgaggtcaggagttcaagaccagcctggccaacatggtgaaaccccgtctttactaaagatataaaaattagctgggcatggtggtaggcgcctgtaatcctagctactcaggaggttgaggcaggagactcacttgaacccgggaggcggaggttgaagtgagccaagatcgcgccaccgcactccagcctgaatgacaagagtgaaactcggtttccccaccaaacaaaaaaagaaatacctagtttctaccagagacagtcacaggcactgtacttctactctggtttgttacctgtgttcttaaaaaaattaaatgctacattttagtaagaggttagtgaaataaaattttaatttttcccatcagaggacatggagcccttgaattctatcccagactcccagggtcttccaggttaacaagtcctgcactaaggaattggctcagtaaaacctcagcattctcacaggaagagcctaaaaaggagactgggataaattagtgagaggtccaaattatgcaattttcttttaaaataaatgcagttttattactttccacttgtagccattataggcagtagattaaatgagtttctagagaaacctcctttaaaaataaagttatttaattagtccaaggtttaaatatttcccctggaatcttttacatgacaatgtcttagccagacaatttttaagaaacaaaattctccatcctaactcctatccccatcaacagtccaaatcttaacctttctttttttttttttagacagagtcgagctctgttgcccaggctggagcgtggtgatgcaatcttggctcactgcaacctccaccttccgggttcaagcgaaacccctgcctcagcctcccgagtagctgggactgcagatgtgcaccaccacgcccagctaattgttgtatttttagtagagacgtggtttagtagagacgacctcccaaagtgctgggattacaggagtgagccaccacacctggccagaaaccaggtgtttgatatcaggtgacggttgtgatcattgttcgcaccactactttgaaatgacatagttgccactggaccttgttatttaatgtgcgaataaagagacagttatttaaggcattaataagagctatattacaagtttttaaaagtcttttgaggactgtttcaaaaagtcttttgaggactgttctcctttgcaatcctctgtaaatgcaccattgcattccaacccgggcaacaagagcaaaactctatctaaaaaaaaaaaaattcatccacaggacagcgctggccttccgttagacttttgctgttgagtctgtaagttttcagcagctgtgtttctccaaggagcggggctactgctggttctttacgtctttcccccactgccctgcccctccctgcaccctagcagctgacacagtgttttgggatttgaagataacacaaaggctgtgttcagttaaacgtatgtctgtgtgtgtgtgtgtgtgtgtgtgtgtgcttgtgtgtgtgtgtgttttaataattttaacttctctgggtgaaggtgtaaattacaaaataaaggaccatgtagaaatagataaaatgactttcatcaagctcaaaatgtgggaaataatacttttcctctaagctcatattttgaaaagttgtttgagactgttataaaataacttgagaatagtctgagcatgatctcatccgctggaacggagtatgaaataaaacacgaagcctctttttagaaggatctgttttatagatttttaaattacagagattccttgaactggaggataatagcgaaggacccacaaaggaaatatgaataaagcagcacaagtttaaataattgaatgtgagcaaaattaaagggaacgtttgtcacgtctgacatgctccatcctcctgtcccccccacactgaaccgtctccaagaaccttccggagagcccacagtgtgaacagtaatgaatgctccatagctggccgccttgcactctagtgggaactatgatgttgggcacaagtgccagcaggaaggtgggaagcttcccggggatgtttttcctggaggtcaagtccccccttgggctgtgaagtagccggtactggggttcatgggcatttcccttccctgactgttcgccagcgtctggcacagcaccagcagcccctggaagtctaggccagatatgccatgtccgagaatcttttgtaaacatttttcatcagtgactcacagctttgagaaaggattatttttatataaaacgatctttcaattttactttaaagacccaaaccattttcttagaatactgtctaaacaagttaatcatgcacagatccagtgaattctgtggcctggttcttataaaatttccaaataattttatactgtcatagacagagccagagctttttagaggtttgaggcattttttagatgtattactgttctcggtgctcaactagctaattagtgattttttctgagtttagttggtgagtggaaacctttttgttaacattatgacaaaataacaatatggttttaagtggagtgagaggcacttttgaagatccagatcttagatccagatcttaaatctgtttaaagtatgactcagaaaggaggctgcagaaaatgttcactaaaaaaatttaagaataatagcagatgctaaaatttatttcccaagacaatagccaaaaagatctgctggaagaacagaagaagggaactagttggggcatcttttttttttgaatgaagccttcagccttctttaggggaatcttgcttcctgacagagggaccggtggaaagtttgtgtcttaagcaagaaagatttaagtacattctgcaactttggccttgtaagctgtgatcatttttaaggttgacgagcatagttcactatgaaatgaagcaagtaacttggcatttatacattgtgagtcaattttgacatcagcctggattgggaattgactggaaggttttggtgttggactgtggctacacttcagtgtctcggtccagaggcatgcatgagcaatacttccctttgggctttagccattaatttgtggaatagagcaagaactggagaggaaagtcgagagactgccttggatcgcctgacgtcctgttgaatcaaaaagcagtgggaggccctttccttcctaacaaaggcctcatcctcttgcataacattcccagcatctgtcgacatgttcgggaccatcccactttaacccacacttcaagtggatggccacctctgggcggggatctgcattctgcttattccaggtgttttccaggccacttccccgattatgtaactttgatcaaatccagatgcggcagaatgtttgatagaagaggtcaaatggcatttgagaagaaaagcatttctgtattcatgactttggtttaatttcctgtgtgggcctggtctgccaaagttgtatgctcatggccacgaggttgacgcaccagagggaggcactcaagtgccttttcaggacagcctgaaggaagcctccctccccagcatgctttttcatgttaaattatcaattatgtaagtttagggccaggcgcggtggctcctgcctgtaatcccagcactttgggaggctgaggtgagtagatcacttgagaccaggagttcaagaccagcctggccaacatggcaaaaccccgtctctactgaaaatgaaaaaaaaaaaaaaaaaaaaaacttagccaggcgcagtggctcacatctgtaatcccagctactcaggaggctgaggcaggagaatcacgtgaacctgggagctggaggttgcagtgagcctagatcgcaccactgcacttcagcctgggcgatggagtgagactccaactcaaaaaaaaaaaaaaaaaaatttcaattggcttctattaaagcttttttatgtttgtcattgttttctagtaataacaacaatccacattttttgtgagaaatataccataatatagagaagtataaagaaaatgtaaggccagacacggtggctcacgccgataatcccagcactttgggaggctgaggcaggcttatcacctgaggtcaggagttcgaaaccagcctggccaacatggtgaaaccccatctctactaaaaatacaaaaaaagtagccgagtgtggtggcgggcacctgtaatcccagctactcaggaggctgaggcaggagaattgcttgaacccggaaggtgaaggttgcagtgagcagagatcacgccattgcactccagcctgagtgtcaagaacgagactccgtctcgagaaaaaaaaaaaagaaaagtaaatttaaagcacttaaaatcccaccaccctgagttaactactgttcacagtttggtgaaattcctcctcgtcttctattttttcatagttgggaccatgcctatatactggaatgtaatataaacacttaatatattattgcgagtatattctcaaacttaaatattttttccaaaaatattttgagtggcttttaaaatatatcctattttatgcatgcagcataaactaacttatcctgtgttgatagatattttgtacttgcccttttctgtgctgttgtttaaaattagtgtatagaaataattgtgttgatcacttaggataaattcctagaggtaaatcagatattaaattctttatagacttctggttcatattccagttgccctcaatttatacacctactactagcattgtatgagagtgcccgtttctctgaaatcttacccacactggctgtcagcgtcaaaaagatgtatctgcagatttggcaaggaatttgcatttcagtgattattatcaagcgttcacacactttccatgtttaatggtaattttttttgtttttttttgagacgatgtctcactctgttgcccaggcagagtgcagtgccgcgaccttggctcactgcaacctctgcctcccaggttcaggtgattctcctgcctcaactccttagcagcttggattacaggcatgcgccaccatgcccggctaatttgtgtatttttagtagagacggggtttcaccatattggccaggttagtctcaaactcctgacctcaagtgattgcccgccttggcctcccgaagtggtgggattacaggtgtgagccaccgcacctggcctttaatgataatgtaaattttttgtgaattgtttattcgtggctttgccccattttttccatagtggagggatttttctttttcttgttggtatgtaaagtccttgtgtgtcaagaatgctctgcctcacagtttttctaatataatgacagtggaagctcgtaactggcttccacttgactgacttgctaaattgaccggcactcttcacttccttataaaacatgcctccatagtccctgtgccccatggcacatgggatggggtagccacactaccactgtctgctgctgcatatgttcctgtccacaagagccagtcatgtttgtttccaagcctggttctttcagatatagctgttgttgtaattacttggttgatatgaaaccaatgaaatgcaagtgtgaaaagagaattgtttctaggaaaattaagatgaatgctttagaaagactcagtaaaggaagataaatttaacaaattactacagaattaggtgtaagacaacagtaaatgattggaatgaattacagaaatctagaaagctttgacagtgggaatgcgtagtgaatggctctaagttctccctccatctgtaggaaattgaagctggaagtgagatgatatattcattatagggaggacttacagaagaaaacatcaagctctaatcacatgtccacatttcgttttgtttacttattttttgaaatggagtctcactctgttgcccaggctggagtgcagtggcatgatctcagcttactacaacctctgcctcctgtgttcaagcgattctcgtgcctcagcatcctgagtagttggggctacaggtgtgcaccaccacgcccaactaatttttatatttttagtagagacggggtttcgctatgttggccagcatggtcttaaactcctgacctcaggtgatctgcctgcctcggcctcccaaagtgctgggataacaggcatgagccaccgcacccagccccacatacctacatttcaaaggacagtctttggccctacagtcaagactaccaaaccaatgtacactaaatgggggtggggatcacgttgttgttttttgtttgtttttgtttgtttgtttgtttgtttgtttttttgagagagtctcgctctgtcacccaggctggagtatagtggcgtgatctcggctccctgcaagctccgcctcccgggttcacgccattctcctgcctcagcctcccgagtagctgggactacaggtgcccgccaccacgcccagctaatttttttgtatttttagtagagacggggcttcaccgtgttagtcaggatggtctcgatctcctgacctcggggatcacatattttaataaaattgataatccctaatagtgatggcgctaggtgtacttttagagccaatgtaaatagtcgagaaagggggccaaacatatgactaagcttcttctacactctaggagatgtcagtattgcaagatcctgttccttgaaattatctttgccccccgccattcagaaaaattaccaaatattgtaataatgtaatttaggacttaccctttcagagaaacagttcctgaaggttgacttcagttagtagtacagaagcgagacttgaagctcttcatggtttatgttctgttggtttatcccaaagagatgttttagagcacattcatttctgaaagttctcggtcatgtttccggaagtttgatcaggtgggttctttttctttttttaaaagataattttttttttaaagataattcagaatcagtcccacccctgagatggtattattacccaggaaagaatgcgtgaggatcctctaaatccatagagaaggaaaactaaaacaattttgttaccatttgtttggctcaagcatctggtagatccttcagttcttttcaaattagaattttcctctctttttcttttttttttttttttttgagatggagtcttactccatttcccaggctggagtacagtggcacaatctcggctcactgcagcctcacctcccgggttcaggcaattctccggcctcagtctcctgagtagctgggattacaggtacccgccactaattttcatatttttgcctggctaatttttgtgtttttagtagagatggggttttgccatgttggccaggctggtctcgaactcctgacctcaggtgatctgcccacctcagcctcccaaaatgctgggattacaggggtgagcctccacgccgggcctctctttttaagataataaaaattactaaacatcataatgacatgatttgggattactctttcagagaaacagttcctaaaggtttacttcagttagtgatttttatttttattatttatttattttttgagatggagtctcactctgtctgccaggctagagtgcagagacgagatctcagctcactgcaacctccgcctcccagactcaagcgattctcctacctcagcctcctgagtagctgggactagtagctggaactacaggcgcccgccaccatgcccggctagttttttctattttagtagtgacggggtttcaccgtgttgcccaggttggttttgaactcctgagctcaggctcaggcaatctgcctgcctcagcctcccaatgttctagggttacaggcatgagctactgtgcctggcccagttagtgatttttaaattgtagttccttaaatgagtattttggatttcactccacaatgttcttcaactgtaagatctacttgaggttatttgatttgctggtttgcaagaactcgtctacacgttgtctttatcacaaagaaattctggagcgtttgagccctgttcaaaaaaaaaaggcaagaagaaacttcaggaacaaataacctatttgaccctgtaatgaataatattcacacattttctaatttaagagctgttgattgatttccaacttttagaatctgtttcagacaaaacatggaagtttagtaacagttttttctattctgtaataataattgccacaaggttaaaaaaaaaaatttacagaagaacatatttgagggtggtcgtgggggcaagaaagctggaaggacgggtggggtgtgttaatagccttgtcttgtgaagtaagtcctcagagacgctgtcctagttggaagaacaggcagtgaaggtgtgcgtctgttacggagaataggactccagtgatctagctggtacttagagaggtgggggtgatcaccaaaaaaacagctctgcctctgggagcggagaggactgggatagaaagtatttgtctttcattttaagcccttctgtacgatttgacttttctttttttttttttttttttttttgagatggagtctcactctgtcacccaggctggagtacagtggcacgatcttggctcactgcaacctccgcctcccaggttcaagcaattctcctgcctcagcctcccaagtagctgggactacaggcacctgccaccatgcccggctgatttttgtatttgtagtaaagacaggatttcactgtgttggtcaggttggtcttgaactcctgacctcatgatccacccccggcttttttttttgacacggagtttctcgttacccaggctggagtgcagtggcgcaatctctgctcactgagacctccacctcctgggttcaagcgattctcctgcctcagcctcctgagtagctgggactacaggtgtgcgtcaccatgcccggctaatttttgtatgtctaatggagacagggtttcaccatgttggtcaagttggtctcaaactcctgaactcaggtgatccacccaccttggcctcccaaagtgctgggattacgggcgtgagccaccatgcccggctaaagcaagaaattttcattgcatattttaagcaaaggcaaatgcatatgtggatagactgttttaatttgactaaagtcatattgaatccatgaattttagaagctcaaactattggggaacaataattaccaccttggagtgaaaatacttaatttccacaagatttagtaaaggaagagttttttaaaaaccaccttaatgataatagtatgtacagatgttaagaaatgaaataggaatgtgtaatgttggaaacacaaatatttttgcttctgagaataaaactaattttttctcccaattttctcttcctttttcttttttctgttcccccctttctcttccagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtaaaagggttgtgggcagctagtggtggttgcaggagatagaaatctgggaattgcggtttgacctaccaccctttgctcgttaaaggagcagctttgaaatctggactgcagggatatccaaaacaacaactgcatgtttctaagggagtcgactctccttagaggagttcttgtacaatagccctgggcaaaaacagaacttgccctattttttatactgaaaaggacagctggacaaaatactgaacgcaatttttcccctaagaaaaagcattatttccctaaaatgtcttatattaggaacagagcacttgaataaacataattgatttataaaaactgaggctatacacttacctatctgttcagtacaaacaggaagcttcaaatgtaaacgtgaattctcatacacttataaatgcatatctttatgtggacttgttaaaatgaaattggtatttaggaatttggagatttttagtagttacacaagaatcaatgaaaaagaacgaagctggtttccaaagctgatatgtctgatttggttcctttcttctcaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaaggtaggggacccttggcagggggcgctgatgggcccagggcaggggaaccagaggtcctgctgtcggattgataaattattgcaagaaagctcaaccaagaagatgtttaaagaatctttcaggtgggagtcattccattagccttatgaagaccctttattgaggatccgttctgtgatattacaagttcctgggactggtatgattctcttattgtcttgctagagttttgttgttagcaagttacttaaaataggaggaatatctgttgggttttggacacattttttacaataagattcttcctttaaaaaaaatattttataatgatagaaatcatccccaacgagaaaaattcaaataatagataacctttcttagagcgaaagaccactttactatcccctcccccacagacgcctggcacgtgggcttcttcctgcggatgaacacattcatggagaggtgtgtggacatacgtgcatacacgcatgcagttttcagtgaaaaccgggatcaaacccacagcttaccaaacccaaagtgtggtgttgtaagggaggtggcctatatgattttgtggtcttcatataaataatccttaagagtccataaagagaagggaggagttaacattgactgaggtattgctataatacctgcatctttgcattaaagaaagggaggcataaagagatcttgcccgatgtcaacctagtgagtcactgatggaataggcttggatcccacagtttattctactgcaccaggctgtagttgaggtacagtgttgataggtggtcccgatggtgtatgtttgtttgtttgtttgtttttgagatggagtcttgccctgtcacccaggctggagtacagtggtgcgatcttggctcactgcaacctctgcttcccatgctcaagtgatcctcccaccttagccttccgagtagttgggaccacaggcgcacaccaccatgcccagctgttttttgtttgtttatttgttttgagatggcattttcgctctcattgcccaagctggagtgcaatggtgcgttctcggcttactgcaacctccacctcccgggttcaagcatttctcctgcctcagccttccaggtagctgggattacaggcatgcaccaccacacccagctaattttgtatttttagtagagacagggtttcaccatgttggtcaggctggtctcaaactcctgacctcaggtgatccacctgcctcagcatcccaaagtgctgggattacaggcgtgagccaccacgcctggccgtttttgtatttccagtagagacagggtctcgccatgtcgcccaggctagtctcaaactattgagctcaagcaatctgccctcctcggcctcccaaaatgctgggattacaggcacgagccactgtgcccagcctatattttttaaatagtatgtaatgcatgcatatggttaaaaaaaatcaaaagaacaaaatgaattacagtaaaaagtaatcgtctcctaattcacttttcctgcccagaggcaagcactggtactagttccttctagagttacctggacacagatggatggtatatagatgtttatgtggatgtttatattcaaaaaggcacgcaaatgatacatgcacgcgaatgcatcatgcttctcccgtgtgataatacaccttcgagattgttttatggcaacaggtttagagctgcctcattcttaccagtgactgtgtaccgtggatggactgtcacttatttcagtagtcccctgctggttgacttttaggttgtttccaatctttagttattgtaaataatgctgatatgaggtggctttcaaaccttttcaaaaatctggttctgctgtaagaaaaactcattttacaccaccacccagccctcacaatataacaaaagtttcatgaagtcttacctacccttactgtatgtaacgcactctgatagtttgtatttcattctgttctatttcattttttaaaaattctggttgtaatccactaaatttatttcatagactgactagtggcccatggcctggtttgaaaatgcgttgcacgtgcttctttatgtgggtgtaagtgtgtgcagataagttgccagaactgactgaaggttatgtgcatcaccaggtcaccctctatagaaattgtacaaatttgttctcccacaaacaatccatgaaagggcttgtttccccttaacccacaccaacagtttattattagacatgtaaaaacacctttgtcactctgactggtaaagaatggcatctcattatgttgaatatccatgtggcatattttgggtcatctttatgccatttagtaaattcatctttttcctacatgttagaaatataccaagtgtatatgtgtatctaggcctgttgacctctctgttctcttccattggtctgtctatccgtatgccagtaccaaacttgtaattgctatggcttcataccatgttgtggtatctgataggctagtccccacttacctttttaactttttttttttttggctgtcttcacacattcacttgtaccatatgaacatacatatacttcctttttaatgttcttatttttcttcacatcccaaagtcttctggctgaaatcctattgcccatatctgatgctttccaccactgcagaattctttagtaccaacactgcagtgtgcgtgacggacaaaagagcctgttatccctgtgtgactagacgtgggcctgtcagcttgctttttgggttattgttcttatcccagaggtggagctgcgttcttccattctgagggacgtacttcaggacattgggccctttgaaagagccttcagaccacaagggtacctttctagtgaatcagaacaccagggtgcaccgcccatggggggtgattttctggagcagacagcttgcttcccatgtgtgctatttatccaaggcaagtcatgctgcaccgagatagtcacttgaggtttgcaccgaacaggataatggtttcttttccctagagctgtttaatcagcaaccttggaacagatgcaggcaggcatgatctagtgtgacagctcattagctaggggttgatctaaaatactgttcaaatgggcaaggaaaggcctgcgtatgggatatgtgatttgcagaatttgagattcatccaaagagggagaatctgcctaagatgcctctgtctaaaagctagtatgtgccaggtgggtttgtttcattccaggtagagcacagggagcttatgtgaccaggcagtgtccaccattgggcaacacatcacacttcccttggcgtcttgcctcctccctccccgtctggcacagactctcccatcagccgtttgggcacctggggacttctgagcccacagcgtcatccagcagaccgtctgcggaggttccttcctgtgagggccgcactcgagggggtgtattgggtgggatcgtatcactggaatgagtgaacatcgttagagggagctcccacagctatgcgtgtgaccgtgtggctcgccgctgaaaaatgctgctcacatagcagaacttcgatgcaatcctttttggatttctaaggggaaattttaagaccgataggaggaataggctggggttgaataagtttggttcttatttttaaattagctcatctttagaaaacaactgaatttagaagattcttctgtaaggccccaaaggatttctttctgcctccccgctcttggctcttatttgtgtctctcctcgtgttctgagcttttcagcagcccttgtgggtcatcagccgaggaccatcagctcggggcccagagctggggactgggagttatgagctggactcttgaaggggccaatactaaaccgagccgttgccatttcctaggagccttgacaggctcaaacatctctgggtacccggggatttgactgtcattgttctgatcctttcccaaagttgtaaccctctgttgacatagcggaattgaagattgatttttcttcaccaccttctgcctaaagttcttagttctgaatgtgtccacacctcattgacttctatgagatgcccctgtcacgttcctcgattccttctagtccttaatagagtctttccttttcttgaaagaaatttgcccagttgacatttattttcatcgtctgctgaagtgacagatccaaggccctaagcttcagcagagttgcaggaagggaccatttacacagcctcttagatgtttaaggtttacccgccctgacagtggctcagcaggcgtaggcctcctggtgaaaagccgagcacatggctaacctgctctggtggaggggctttggaccgttcttgtgtactgcgaggcttgccttcctgctggtgtgtgagcagctctcgggggaacttgcttcctggctgagcaacctgtaaacagtatgtctgaggtgggactcccgggcccaaagcagccaaaggttgcacaagtctaagctccgttaggcctgtcagtgtggctgtcaaaagaaacgctgtttcttttctttctttcctttttttttttttttttttttttttttttgagacaggctgtcacccaggctggagtacagtggcacaatctcggctcattgcaacctgcgcctcccaggttcgagcgattctcctgcatcagcctctcaagtagctgagactacaggtgcccaccagcatgcccggctaatttttgtatttttagtagagatggggtttcaccatgttggccaggctggtttcgaacgcctgacctcgtgatctgccctccttggcctcccaaagtgctgggattacaggcgtgagccactgctcctggcaaaatgctgtttctaagcgtttctttgacaagtcccatccttcaggttcatgcatgattagggagaggcagcagccctgactgagcacctgagtgttcatggaaccaggtgcatagcgtaatgacatgccattcatgacactactttcttccctgaacatgccatgaattcctgatgattacacagttccccaacaagtgctgctcaaaacctggaactaatcagaaggaagcaccagccttgactgttagtgggacacggggaagatggctgtgaaccaaatatgcggtgcctttgggggagaatggttttagtatttagtaagtgtcagtatgtaagttttatgttgaaaaatgaactaagtcacaacaaggtctataaatttaattattgaaaaggataaagttgggccattcagtgaaacctcctgtaactgaagtctctaacacagtagccaatgggggaatcaaatgagcccaagaagaaattctgcgtaaactaggacttaggggagcccttagcattccactttggagtgaaggaacccgatccgccagttggggaacgctcctttgaggcccatgtgcttcctgctccgacgggagagagggataatgagacttgctcccaggtgccctgccctggagcccagcaggccacacgggctctttgactctgtactgtgccagtgatttccaagatgggagtggtgctctgattgcaggaatgtcttcttggaatggcttttctcacttctctagagtccttggtagggagcacatcatcagctgagctaacgtgagaacaggggttggagcacttgccaccggcagtgaagtaatcggacagctgacagtcttttccagagggtcggggattgggagctgaccccaggtcccgctccgttttctttgtgtgcagcacttgtgttggtgaccagcagtgaagagagtgcgtggacgtcaccgtgtggttatgaagctaacggcagccctcagcggtgccgacttccgctccccgacacattcctgtgtgcacgttcgtgggtctgagcgtgactcatggtgtgtgtccctagagcagttcactcagaggcttctcttccgtgctctcaagaataaaagcagggccgccacatcctgataagtcttgccattcagcggtcctgtcttgcagagggataagccagtgtccccaggccacagtccttacaccttgagcaagttccccagagtgaagcaatctttctagacaagttttgcgtttctcagaattttattttagtgatattgttaccaaaagattgtaaccccaaaatgtgtgcctttggcttgcctgttttaggaattcacttgtgttatctccccaagcaaaacaaaagaaagagaaaccttcctgttgacgaatcctttttaccttcttgagagttgtcaatgggactaacttgtatatttctttgctaccttcttttaaaaacatttttcttatttactattacagacgtatagtaatggtgcctgacataacccacagccaaaggccttggccttgctgtgtgtatttcaggctttttcttcccttttctttttttttaagtaataagatattacagttatagctgaagcctgatcctgttcccttttctccctctcgtcccaagcatcaccactgtcccaaatctgctccttcttcccacatctttgcagtttgggcaagtcttctgaatgcctagtcatgattttaagtcttctttccaccttcagtgatggttggctaccctgagcaagccagtagattcagttatgtgcctggagtccagatgttttatgtggatttttcatgtggaattgtttttggtaaggaagtattcccttgccacaccaatgaaaagagaagaaaacaggtagctggcacccactgcattgttgctttctgccagcctgctccttctccttcctctccagctctgttgtgtccagatgcaaactctacatgcagggtttgaccctaggtcctcacctgctgtagctctcacacggggaccgaatgctcttgtgtcgtaaatccttccttttgcttcctcgtgttggatgtgtttagtggttttcatcttctggtcactatttcattctaggtttatcccctttaaattataaattaaatgaattcttcgcttttcctaccagcaactacccaccaagttctaccatgtgttaatttaatcaacagttatttattgagtacttattacatgttgatttcctgttctcaacattggaatgaagacagcttagggttctgctttcatgaagcttgcatgctcttaggtggagacagacagtaattaagcagataaacaggaaattatgagctagtagtgggtccattgctgagaagtaagacaggtggtaggatgacccgtgccgtgtgatgactttagattgggtggttggggaagacttcacggaccttaaaactggccttggaacgggaagcgagaactgggcacggaagatgagggagtgggagatttcaggcagagggagcagcagcaggtacagaggccctgaggccttttattgtgtctttttgcttgagcgagtaacttagagcacacgtagagaaagacagcagaagtgatcttctaaacactctgtcctgtgtggagagctccttatgtgagattttgctgtgtagtgaattaaggctcagccaaactggctcacgtgagctctttgagcttgcctgtctctgtgggctgaaggctgttccctgtttccttcagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggtaggctgggactgccgggggtgcccagggtacgtggggcaaggcgtctgctggcattaggcgatgcatctgcctggaagtctacctcctgcctgctgtccgagggcttcattggcgccacggaattgacttttccgtcttatatcattcctgtgtctttgtaggagtggaatcattctcatagtccgagtgtgtttccacatatggtgagagctgacaagcatggaggggttttggtgtaaaaagattagtcatttggagaggttttctcattttatggcaaggttcttttaaagccgtggatttccatgctgttcgtgcggcatggagatcacttcctaccgagagttaaggaggaaaaaaagatctctgagttttgaaagaagatttaaccaaaatgcatttgactcttctgtggatttttgttggctgatttggaaggcaggtgccctgggcatccccagtgggttccaattctgcagctgcccagactcctgcaggcagaggtggaagtgtccccgctagaaaggcatccaggaaactcgcttttgaccaactcagatacagtctggtctttcttgttaactgggactttaccctctccactaatgaatagtgtttgtagtttccaggcaggtttttttcttcttttgaagttctttgaaacccttaggacgccaagggaaggaagttttcattttcagccctttgcattcttcaaaatgtgatccaggcttttccctgtggcgagggtgtcccctagtgttgacttacattatttccacttgttttaaatgaactttgattaccttgacctgtgcacagaaatcaagagaggcagcccctttttagagctgttagaaaagaactgaaacatccacctctgggaaaaatagagtttagtttgtgcatgtgtctcagaagtcaggtgcacacattgagactggtgcagccacatgcctgccttttagggactccttgactgacctgatgccttcacccaaaggcatagtgaaatgggaagtatgatttctgactggtatgaagtggctgctttagagaaaagatcacattctttagtcctagaaaccaaaggtggcttcctgatgctcttattcagcacgtgcctgtctttgaggcaggactggcactggggtgggggcatggtttggggttaccttaaggaccctggatatttctcagataggactttttcttttctttttttgagacggagtcttactctgttgcctaggctggagtgcagtggcatgatctcagctcactgcaacctccgcctccccaaattggcgattctccttcctcagcctcacgagtagctgggattacaggcacccgccaccacacccagctaatttttgtatttttagtagagatggggtttcgctgtgttggcctggctggtctcaaactcctgacctcaagtgatctgcctacctcagcctcccagagtgctgggattataggcatgagccaccacacccggccctggactttttcttaattgaataaatatttatcaagttcttcacttctatttgacggttcctgggctcaacactggattagaaaatgaatgggacagagttcttcatctgagacatagggtggtccaggtagtaggaggaagaaggattgcagcgcagcagtcctcgggacaccaccagggggtgaacgaaggagggacgggggagctgtgcaggtgccccagctccttgggttgcacagggttgaagaccagacccaagaaatggggccttgaccagctcagcaaactgagaatggcctagatttcagcacactttcaccaggatttgtcaaatgaaggaagattccaagcgcaaaataccctagatttcaaccagtaaaagcttgtctgaaaacttccaagatcgggttgtacaacttgacatttgaggaaacgctacttcagtagatggtgctgtggcattgttttctgaacaactgaaggaggagactccagagaagggtacctgctggagacctgtgtggtttgtggggtgggtttcttatatcactgaatctaaagtgggtgcctttcagaatgtgctttactaataatgtgttactctgcttttaattatacttctaataatttttcccaagagcctaattaacttacgatctcacagttggtaaagaattacaggatgtcattgcgtggatttctgtgggcagtcacccggagtggtatctaattagggaaaaggcagtatgtccctttctggaagtgtgttaactgaaaatacggtactaagcaactgctaaataaattagccctccttcctcctggccgtgcgcagaaacatccctgcagtatgttgcctatttgtcaaataagattagtgtaaatatggggcatttacctttgctatagaagctgaaattgccaggcacggtggcttacgcctgtaatcccagcactttggaaggccaaggctggtggattgcttgagcccaggagttaaagaccagcctgggcaacatggcaaaactctgcctctacaaaaaataccaaaaatcagccaggcgtggtggtgcgtgtgtattcctagctacttgggaggctgacatgggaggattacctgagcccgggaggttgaggctgcagtgagccgtaatcgtgccactgcactcctacctggggagcagagtgagaccctgtctccaaaaaaaaaaaaaaaaaaaaaagctgaaatccttgagtggattctaaatcatggcagtggctaacattcagcttcatcgtgcccttgctgtgtgcctggcagagacctctgtgcttactacatgtcgcatctcattgaatcctcacaaccttaagatccttccaggttgagcatcccggaccctaaaatcccaaatcctaaatgctcccaaatccaaaactttttgagcaccggcatgcagctcagaggaaatgcatactggaacatttcagattttggattttctaatttggagtgctcatctggtaatatagtgtggatattccccaatctgcaaagatctgagctccgaaacacttgtagccccaagcctttcagttaagggacattcaccctgtatcaacattttaatgctgagaaaatggaagagagagaggttaagtgactgacctggcatcacacagccaggagtggcagcatcaggatttgaactggggcactcagctccaaagctcagctcttcttttttaaaattgaacccagattcttatttctcaaataccataaaatatttacataagccacagttatgccttttaaaaaaaaatcaccttttccccccactctcccatttacttcctttgcagtttgtggctacgatctaccttcctcttcaaaacccttgaaaaatccttgcagccttgcccaagcgtccttccctcagccgatttttgggcctcagtttcctcccatccagcctgtttcctatcgctggcttctccaagggcagagccagagtcctcttttgccagcagggggagcaagggcctacttttaaccgcaactccatagtgaacaagtcaagcaaccttgggtcattcatataccttccaggcagaaggaagacagaagagaacaggaaaaaagcaggacactaggctgacccctgcagatgggaagctggaattacagcaaaggctcattgattgggaactgcacccttgaattttgatagtattgggcaggacatagtcttgctatctgtgttaaagggaggacgtgcttaagaaaaccaacagtcaagtacaagaagctctaattttttttgaggtgggggaacggggtctcactgtgttgcccagctggcctcaaactcctggctcaagcagtcctcccacctcagcctcctgagtagcagggatcacaggcttgtgccactgtgcccagctaagaggctgcaattttttaatgaactgtattcagagtttgtacatcagtgtcttttttttctatgaatcagttctctaagtaatagaatttggaaaagaccgctggtgatctagctgtggcatttagattgactcatgagctaactgacaaatttactacttaaacagtggaaaataatgtgcaggatatatttttttgaataggttgtcccaccctcgagttctgtgtctttcctgagtccgcatatgtgaaccttgttttaaccaggtgacagcatcccataggcacggatctctgtcttctgttgtccacatcatgtgtcttggcagttgttccttattgatatacataaggttgtcttgtttttgtatggatatattttaacatgtaccagtgttcagtgggcctttctcttatttccaatattttgctgttctaaacagcagcacagtgattcccctcatttgcatgtatgtgaaactatcctggtgggtccgcttccagaaactactggatcagggaccatgtgcatttatggccttgaccatactgccagagtaccttccaaggagtttgtgtcatcaatttgcactccccagtggtgttgagagagtgcctgtttcctccacccagcacagtgtgtttcggttttatttctcccaggaaatgggtgttagttggggagctccagaaagaagccgagaagaagggcagtcgtacccttggcagttgtacgcagtggctctctggccgcacaaggagggctcggagcctgctgttgccaggttgcacttgctcttgcaagacaggcattccttgcagtgggttctcctctggccagggagatgagttctgggggctcctctacgaggtggtctctcctgggctttcctctcgagcttcaagtcccacctctggagtgtgaatcgccttcctcagtctaactctatccctccagtggtttttttttttttgctttttgtttttgtttttgtttttttgagacagagtctcactctgtcacccaggctggagtacagtggcgtgatctcggctcaccgcaagctccacctcccgggttcaagcaattctcctgcctcagcctcccgagtagctgggactacaggtgcctgcgaccacgccggctaattttttgtatttttagtagagacagggtttcaccatgttagccaggatggtctcgatctcctgacttcatgatctgccctcctcggcctcccaaagtgctgggattacaggcgtgagccaccacacccagcagtctcttcagtgtatttagctgtgttgatcctgattcatctgatgggtgaaggaatattggaaataaggataatccctgtggtgtttcactgtgcctgtaacctctctcacctagcatttggttaaccagaaacagatgtggaaactgatctatctgtagataatggccctgctcagggagggggtccctgctgagagcgagacattgaaagcctgctacacagaaactgctggaaggccaagccatttcttttttctttttctttttttttttttttttttttcagacagagttttgcccagtagttcaggctggagtgcagtggcatgatctcagttcactgcaacggcctcccaggttcaagcaattcttctgcctcagcctcctgagtagctggcattacagactcctgccaccacgcccggctaatttttgcatttttagtagagacacggtttcaccatgtggccaggctggtctcgaactcctggcctcaagttatctgcctgtctcggccccccagagaggccaagccatttttaaaaacagtgttctttttcatgctgtagaatacctgtgcttgggggtgagcaaaaaggaggaaactgattagaaaatacctatgagggccgggtgcagtggttcatgcctgtaatcccagcactctgggaggccgaggagggcagatcacaaggtcaggagatcaagaccatcctggttgacatggtgaaaccccgtctctactaataatacagaaaattagctgggcgtggtggcaggtgcctgtagtcccagctactcgggaggctgaggcaggagaatggtgtgaacctgggaggcggagcttgcagtgagccgagatcgcgccactgcactctagcctgggcgacagagcaagactccgtctcaaaaaaaaaaagaaaatacctgtgagatgttgagtctgggagaatgtatctgtgagaagacaaacaaccctagtattcattaaagaaccagcctttgttttctacaagctatctgttcggtctactcaggaatagagataaactgccttaatagtaataaaagcaagcaccgctgagtgagtgctggcctcatgccaggaactgctcttggcactctgtgcacaagggagatactgacattctttctgttgtgcagatgagaaaacaggctcagagaaggtgagtaacttaccatggtcacacagcagcagagctaggtcagtataatccacaagtcattctcttaaccgctccgccgtaccgcccagaatgttcatctgcatctgggccagcctcgtcagtccgtgcaaagaggccagttgacccatctccctccctaacaagcacagaagagaccaggctgaaaattcatagctttcactcaaagtgtttccttcacctcattcatctgagttagctttattttactatataaagagaattttcttcagcaaaatgataggaatttttttaatgaaagtaaaggaatgtcacagaattgcgtcagggatatttccagtttaacacaactacaaacgtaggctgttttgttgttgttgttttggttttctattttgagatgaagtctcactctgtcgcccaggctgaagtgcagtggtgcgatcttggctcactgcaacctcctgctcccgaattcaagtgattctcctgcctcagcctcctgagtagctggaactacaggcatgcgctaccacgcctggctaatttttgtatttttagtagagatggggtttcaccatgttgaccaggttgttccggaactcaggtgatccaccttggcctcccaaagtgttgggattacaggcatgagccaccacactcggccagctgttgttaatagttaaaattataaattggacaaggtctgattccagcagggggagacaaattcacattgatttttctataagaaaaggaattatttgtactttcctcccttgtgtgtttgtgtgtatgtaagagagacagatgagaagagggctgcctttgagagccatgttccttttgcatgtacatacctctcaagattattacatgggtcttttagaagagggtcagtagctataaaagcaaatgatatttatgaaatgatttcattgtatgtggtttattatgtagtcttcaaaacagaaaaaccccacttgcttcgaaagcttcctttgagagctactttttaaccatattgttgatcaagcaagattcttaaagccccagtcctatacgtgagcagcattgaatccccggatactggcaggcgttcactgtccagcctttgacattagcatgtcaccctggtaaatcagagcactccatgccaaaaaacagcatggtctgctgagcacattaaggagcagagagggctcagaagaattaaacggccaatggggtggtgacagaggtgagctctttccccctcggacagcttggcatggtgactaccaatgaggtttaattgacattaagagcagctcaccatttttaaagagcgataaattgtttccaagtttcagcctcacggagccctgagctaagagataatgggctgacacatagcctcattggtcacgcttcacttgtaaacaggattggccaaagcaagaaggctgtaagtaaaggttggcccgtcctctggaagcctcccccacagcagggtggggaactggggcagccatagcaagcaggaccatcaggacacggtgtctcccaaacgggccggaacatacaaggttctacgtttaatagaaagttgatcaagccttcctctttggggagcctaatttttaagccattcactctctgttcccctgcagtcttttctctccaaactctgttgaaacttggaggcatctcgcttcctcctttggcctttgtagccaggttttcgcagcaaacagaccatatcatttaacacccacctgcttcttgttctgatagtcagttcagtagacagtagcattttttaagtcaaaaagaggcttagtgatgtaggccaaggtcaaggctctgtgtcatggggctctccccagggctcagtgccacggcacttcagacttgaccccagactgaaaagatgagaggacctgtagaagtcacggcctgtctgtcccgggcccatgctcctatctttttctcccccttggcatttagataccatggacttgttaaaatgtgacatgtactgatgatccttatgaatttgttggtaggggagctgctggtgaggattattttagactgtgagtaattgacctgacagacagtgatgactgcttcattaagagcccacgaccacgtgccagaatagttcagcatcctctgttgctactgtactttgagacatcgttcttctttgtgatgcaatacctctttcttgtcatgagggtctcttcccttaaatcaggtacatttcagattcttcaggtgatgttttttaggctgagtgtgttagcaccccttggaaaccaggttccctggggaaagtgtgtcacgtttgtggtgtttgcccgtatagctctcccacacccccacgagctccaagaggtggggaagcacatgtggcctgcctagcaggcaccagaagcaggttgtcggcacatgcaagccagctttgccctgttgcctgggggagaattgaaaagtttggccccaaaggggaaaattctttctgccatcaagttgctggtcagctgtcatggaacctgtctgcagcaatgtggctgtcacaaaacgcagcccaggacgagtatgcgctgaagctccattttgcattaactagtcaagtacttacccactgaaaagcacttcctgaaataatttcaccttcgtttttttccttctgcaggaggacaccatggaggtggaagagttcttgaaagaagctgcagtcatgaaagagatcaaacaccctaacctggtgcagctccttggtgagtaagcccggggctctgaagagagggtctcgcgccgcacccccagggtgacacaggcgctggggaagacgcacgggcggctcactgcacaaaacctcgttggaatatttgtgctctgccgacgttcagccgcgggtaaaatgaggcctgtatgggatgggtgtgtgcgtgtgtgcacatatgcacatgtatgtatgagagggagaatgtgattattttaagtggatacctaaaagcagtcaaatgcaaatctgaaattagtttctgaaacttgggcattttccagagttttctcactgaagtgattctgtaagtagacacataaccatcagacctaaccattcaggggtaaactgacggtggtgaaggtcatttgaggtggggccaggtctgcgtctgaattctgtggcagcctctccctgcgtaaattcaagttcactggcttgagaagaagaaaagagcctggccatgtccctcccacacgagcacagtctcaggatgcaggtgcttgggaccatgttggaagttgggcccaggactgaggagcagagtcagaatccttcagaaggctttttctttagacagttgtttgttcagttgggagcggagccacgtgttgaagtcctcgttgtcttgttggcaggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacaggtaggggcctggccaggcagcctgcgccatggagtcacagggcgtggagccgggcagccttttacaaaaagccccagcctaggaggtctcagggcgcagcttctaacctcagtgctggcaacacattggaccttggaacaaaggcaaacactaggctcctggcaaagccagctttgggcatgcatccagggctaaattcagccaggcctagactctggaccagtggagcagctaatccccggagtaaggaatatttcatttttgaaccattttgggctaagtggaatattaaatgaagttcataaaaggcgtccttcctaataatcacagtcccctctgaaagagagtactcattgttcctccggggccagcgcccagcagtaatggcctcttcctgggagccgctggcattgcttttacgcaaactcatgggaacaaccagtacatggcttttgttttttagtgtgtgtgtctttttttcctgctttctctttattatcttttcattctccacttaacttgctgtcctctgattcagggatgtttccacaattgtcagaattgtgtatgtggaggtctaaattaagtgtctttgctgttttaaaccctgaagtgttttgaccttcaaatgtgccacaattatcttggtcttcaaattctttgctggtggaaatggcttcccagcaaagcgacggcctgtgcaggacagagcctgatgggctttgctggcgtcttttatacgagatgttctccacaccaccactgtgacctttcctacccaattagctcaagtatgaaacctctacatgagatttcatagcaaggaataagggtagcatgtgtgaaatgctggcggctccttgtaagacagattttctatgctccatgagagcctgatccagatactcctggctttcaggaaagtgaatcctctgatgctgcaaattgagattgcttgacttctggtttgcctggcacggccgggtccgttccttcttcattcaagcgaacttaaaatgctttatcaaaatcctcttaggcacaactcttctgtatttaatttcactcttgttgctgacgatcaggctatctcacgcagccatcacctcaagctgctgccccctctcattccgctcttcccgtttgccttgtgatttcatggttaatgttcatgaaccaaagattagactcctacctccctgggagaatcaggaagtgagaggaagcagattatacaggagagagttttttaggatacatttgggtacacctcaggaagaaagagggaagtaggaaacacagtttgggtaaagaatgccatgggctttgttttattttgtcccatcaagtctgaataggacaagtggagatgcactctgatagaagtttcttgcaatcaaggactgggctcagtgtttgtctccgtgcctggcatagagtagcaataactgcacttactattctcgacacttcaatcaaagcacttagcatattaattaattacactcacagcaaccctaagaggtaggtgccattattatcgtcttcattttacggatgaggtaactgagtcccagggtaattaacttgctccaggtcatgaggccagggagcccgctcccagcaccagcctctccccatgttgggatctcagggtgtgtttgctgagaggctggcactgtgttaattgccgtgggcattaatacaaacttccagggcattggactcaatctttccattgtcagcattgcacctttgctcagcagtggtggatttgtgaagtggaaggttggccaggagctctcatgggtgaacattttcctttcttagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctggggtaagggctgctgctgcactgaagtggtccttcctgactacaggagggtttttttctgcctctttcttgctcttccctttcttttcttcctttctttttgtttttttgagacggagtctcactctgtcacccaggctggagtgcagtggtgcaatcttggctcattgcagcctctccctcccgggttcaagcgattctcctgtctcagcatcttgagtagctgggattataggcacccgccaccacacccagctaatttttggtatttttagtagagatggggtttcaccatgttggccaggctggtctagaactcctgacctcaggtgatctgcctgccttggcctcccaaagtgctgggattacaggtgtgagccactgtgcacagccacccttttttttttttttttaactgtgtatttggcctgaggtccaaatatggtgcacagtgtatctgctgatctgttaagtctcctctataagccccctctccatgtctttatttcccttgctgtttattgaagaaaccatccttagagtttcgtacgttctgggttttgctcattgtctcccatggtgtgatttaatatgttcctctgacttcagtattcctagtaatgggtggctggatctggaacggcctcatcacattcaggtttgactgtttctcttttagtaagagtggatcaggggagatggtgtgcccttccatcagtagatacaaaatgcttcatttatttccttccttcctttcctcccctctccctcccctcctctcttctccttctccttccgacggagtttcgctcttgttgcccaggctggagtgcagtggcacgatcttggctcactgcaacctctgccttctggtttcaagcgattctcctgcctcagcctcctgagtagctgggattataggcgcatgccaccacccccggctaatttttgtatttttagtagagacggggttttaccatgttggccaggatggtctccaactcctgacttcgtgatccacccacctcggcctcccaaagtgctgggattacaggcgtgagccaccacgcctggccccaaaatgcttgatttgctatcgtttttttgtgggggtttttttttgagtaatttttggcagttactgatatacagtgcctagatccaatagtttgctaggtattgccaggtaggaattctctaattctgtcattcctgttaagttactagtggaaacttgtatgaggagaaacagttcctcatctgtgtggttactcagtggtacagttcatgtaggaagagcagggtcaattcttgcttctttgtttttatttaccagtttttaaaataacaaattactttttcttttttttttttggagccagagtcttgctttttctggggtacaaagtacaggctggagttcagtagcatgatctcggctcactgcaacctccgcctaccagattcaagcaattcttctgcctcagcctcccaagtagctgggattacaggtgcctgccaccacgcctggctaaatttttttgtatttttagtaaagatggggtttcaccatgttgcccaggctggccttgaacttctgagctcaggcagtccacctgccttggcctcccaaagtgctgggattacaggcgtgagccaccatgccctgccacaagttggtttctttttttttttttttttttttttgagacagtctcactctgtcgcccaggctggagtgcagtggcatgatctcagctcactgcaagctccgccttccgggttcacgtcattctcctgcctcagcctcccgagtagctgagactataggcgcccgccgccacactcggccaattttttttctatttttgtagagacggggtttcactgcgttagccaggatggtctcgatctccggacttcgtgatccgcccaccttggcctcccaaagtgcacaagttagtttcttaatacccttcagtggtggccaattaggtttttgctgtcattggtggtattatgaactctcagatttatatatatctgatgtgtttcagtccactgcggttattttccctgttgatattcagattgtctcgtctttggccagtgggaacttcacattagctcctagtcattttgacattaactttgtagttttccatgacgtccgcgccctcaaatgacaagctattgcaggttcattctgtgccccaggcctgaatcacccatttctctaaggaatcttatcctttaatgggaaatggaattttaaggcaataatctcagatttcaaaactttcaaagatttcataagatttttatgaaatgtttagagttagaaggggctttggagatagtcttgtgcacccagaaagcagtggtggccggttaggcacagagctggttggtcacagagctaagagttaacatggccagctgacttccggcgccaggttccttctaccacatatcccagcaagatggtcacattacctaaaagaccccacagggtctgaaactcatcatctgccctcctctagcatgtttgtggggtaagtttactgagtcttgttctgtcctggtctcctttttttttttttatttttgagacggggtcttgctctgtcgcccaggctggcgtgcagtggagcaatatcagctcactacaacctccgtctcctgggttcaagcaattctcctgcctcagcctccaaagtagccaggactactggcgtacaccaccacacctggctaaattttttttttttttttgagatggagtctcgctctgtcacccagcctggagtgcagtggcgcgatcttgatcttggctcactgcaagctccacctcctgggttcacaccattctcctgcctcagcctcccgagtagctgggactataggcatctaccaccacgcccggctaatttttttgtatttttagtagagacagggtttcaccatgttagccaggatggtctcaatctcctgacctcgtgatccgcccgcctcggcctcccaaagtgctgggattacaggtgtgagccaccgtgcccggcccctaatttttgtatttttagtagagatggggtttcgccatgttggccagggtggtcttgaattcctgacctcaaataatcctcccacttcagcctcccaaagtgctgggattacaggcgtgagccaccgcacccagccttgtcctggtcttctgatgataaagagcctggtaaaatgtcagagcctgggctgctgctggggccatcccttctgaggtctgctgcaaaggtaactgattttaaatgtagtgtagtgaaatgctacacatcttgaacagcctttctctttcggttttctttcagcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgtaagccttcctcagcctgttctcacgagtatatgtgggcattccaggaaattcaactgtgcaggagtgtgtacacaaagttgaaagtttttccatgagctctctccattccagttcttcagatgcagctaatgtagccatttgctacctattgacctttatttacagataaatagtatgtgcgtgacttgtcttttaaagcaaaaatggtattgatagataccaaacctgggtgtattcctaaatacagattcctgggccctgctttcacagacattctgctatagtagctaagctcatgaggtgattttttttttttttttttttgagacggagtttcgctcttgtcgcccaggctggagtacaatggcgcaatgttggctcacttcaacctccacctccctggttcaagcgattctcctgcctcagcctcccaagtagctgggattacaggcatgcaccaccacgcccggctaattttgtatttttagtagagatggggtttctccatgttagtcaggctggtctccaactcccaacctcaggtgatctgcctgcctcggcctcccaaagtgctgcgattacaggcgtgagccaccacgcccagctgcgaggtgatttttatctggtcgttttatactgattacatatgtgttatctgtactatgcacacacaggatgttttcatatatcttataaggtatttatatggccatttcttacactgttttcccacacatgtctttccacgtccatatattcagatctctccctctccctacctcttatttatgtatagctgcccagtactccatttcactcattcatccggtcctcttttgatgtgcatttggttgttttacacatttgtttggtttttgcccttataaacaaagcagaaacaaatattcatgtacacgaatctctgggcactttggctggtatttctaaaagttgaactgttggttccaagaactgtgtgggttttaaattttgatacattttaccaaactgttaaaaaaggttgtgccattgtatgctccagtcagacgcatatgggagtgactgttcctggtccccagtactaggctttgtcagtctgtttagtcctcatgttagtctcattttcatgagaatttctttacttcagactttgataaccgtgaagaaagaacaagatagaaggtgagctgtttggcttagtaattttctacacctactagagcgggactgggaaaaatatatttgtaaatgcagttcttgctgtcactgtctctctggggttttacaatccatattcctgccagcatctaacgtcttttcaaattcttaatgtctataacaggacatgatgacattcatcgttttgacttgttgcagcaaaagatggttagcaggattggaatgttgctttcattctagacttttccttgagaactgctagccccgtattgctagccagatctcatggatgatctgacttgggtttcatctgtccaggttggcagtggaatccctctgaccggccctcctttgctgaaatccaccaagcctttgaaacaatgttccaggaatccagtatctcagacggtaaagtacccatcccggggtacctgcagtggggtgaaagggcagccatgtgggactgcagcctgggtcattcggttcacttcctggtgaaagttcacagaccagcctgtcctgagaccagaaagctgggcagaggtgtggagtattgtgctttcttgtctgctgcagccctgcagagttctaagaaatgctaagggctgtttctccggtatccacgtgccttttctttagttgtatgcagatgagcactgttaccttacaaagaaagagaaccaccacaccaagccaacaccagtactgatggctgctggatttttgtttctgtccctgtatgattcttagaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcggtaagtcccccgcttcccccaaccccactgctcttcccttccctgccagaggctacattcaggccatcataggccaacgggaagctgtgaatggagcccgcacagaagggcagccatggcctttgtcaatggttcagcttcggaaggaggaaggttctcctctccccacctgcctcctatcccctccctctgagagtccccgaggagcataggctccagcagtgagttcagtcctgtaggcagaggtgcttctgaagcccgccaaggagctagcccatctcccacctattacccgcggcatctgtggttgctgtctcagagcagattcaacaatagtaagcaccaggctgcgtgacaagcagctcacggtgaaggcactgatgtgagaagctcgctgcagccaggtggaaccaggacacgcacatggacagaacccgtgtcctggtggtctctgggaagagcatctttctggtgccattgcctaggcgagcaagggagttgggatcagctcaggagggggtctcaagacactagcaaaaataataatggccaacatttatgtagtgtgcctactacaggccaggctctgttctatgttcatggttgacccccagaaccagcagtccaggttctgctgcagaccagctgaacaaaagcattgaggggtgtattagtctgttttcatgctgctaataaaggtatacccaagactgggtaatttataaaggaaagaggtttcactgactcacagttccacatggctggggaggcctcacaatcatggctgaaggtgaatgaggagcaaggtcacatcttacttggcggcaggcaagagagcttgtgcaggggaagtccgctttataaaaccatcagatctcgtgagacttattcactaccacgagaatgtgggagaaacctccccatgattcattgatctccacctgaccccaccgttgacacgtggggcttattacaattcaaggtgagatttgggtggggactcagccaacccatattggaggtggggggtaggccaagcatctgggttcacagaggatcctggggatggcaatggtggactccattctaatggactgcagactgggtacatgtgaagggactggacaaagccctacttcttgaagatttatggtgggatgtttactgacagcagaatctataaacctgagttttatcacgtactctcattagtaaaaaaaaaacaaaaaaaaacagaacatgcagcccatatatatggtatataaagtacgtatgtccactactgtaggagtagagtgcgtatgttatgtaccaaaacgcacatttaaaaggcttgcatgctaaataagtccaaatttgcaatacttcccgccccgctgggccatctcactcacctacttggaggttatggcgtatagactctccagaatcttccacccttcctcctcttatcggttttcctgatttcaggtggctgagcagtagggaggagaggcctctgggaacgctgtgcttattaagaacccagtgatcagcagtcatgttcatttacgcccgtcagtttcatctgaggggtattttgatagtgatctcttggtgagccgagggtgtcaattaactgctcagtgctgaaactgagtggtgcataattcattgcaatttcactctcctggcctccttccactagattaaagttttgggagggctttggtgttccctgattcagatgtcccgcgtgctgccttgggttctgataaatgcatactggtacctctgttgagttacaggtgccaacagaaaacctcttcttgcaagctgacctctgagggagaattctgttactcactagcaggagcttggcaacaccaaaaagatttccttttttttttgagatggagtctcactctgttgccaggctggagtgcaatggcatgataccagctcactgcaacctccacctcctgggttcaagcgattctcctgcctcatcctcctgagtagctgggactacaggcgtgtgccaccacacccagctaatttttgcattttttagtagagacggggtttcatcatgttggccaggatggtctctatctcttgacctcatgatccgcccacctcagcctcccaaagtgctgggatgacaggcttgagccaccgcgcctggctaccagaaagatttcttatgagctatgattcatatttaaagagtgcccattaaaaaactgttggccgggcgtggtggctcacacctgtaatcccagcactttaggaggccgaggtcagcgaatcacaaggtcaggctcccgtggcacaagctgggggctgcccccaccccatgctccccagaggagcacccaagcgtctgggctcagacaggcctggatctgataaccggctctgatgccaccatccctgaggccaggcaagtcccagccgggctacagcactgttgtgagaatgcagatgaggttgtaaaggtgaagcacgtgtcacgcttctctcaataaagccatcattgctgttaggattgtcattaggaaaggctttgggccgggtgcagtggctcatgcctgtaatcccagcactttgggaggccaaggcgggtggatcacctgaggtcaggagtttgagaccagcctaaccaacatggtgaaaccccgtctctactaaaaatacaaaattagccaggcgtggtagcgggtgcctatagtcctagctacttgggaggctgaggcaagagaaccatttgaacctgggaggcggaggttgcagtgagctgagatcgtgccactgcactccagcgtaggcaacaagcgagactccaactcaaaaaaaaaaaaaaaccacacacacgctttggtctctttccctgaagatgggaacaaaaagctggacggccctggcctcttcatccctgcactggtttacttgaaggcagcagccccccacccacccacatcactctctagtgagtataaaaacgatgacaaggccaagcaaagggtcaaaacctgtggctctcctgccagccagctagccgagaggcctatgaggagctctgggaataaggggctgtgtcccacagtggggaagggacaatgggccattatgcacaggagataagaagggatgacctttgacaatttttttgtttgtttgtttgtttgttttgagatggagtctcactctgtctcctgggctggagtgcagcagtggcactctgcctcccgggttcaagcgattctcctctgtcagcctctagagttgtctggagttgtcagctcttccccttgcgtttcagatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaattcttggcagattgcttcggcctgtgatcctgccctgttgttctgagcctgtgcggtggcggggccgggatgtagtgggttctggtttcccgacggggctggggcccggcatcaggtcttacagagcagaacggtggcaggttgcccccagctgcccagggcctctgcggcctgggtgcccacagccatctttcaggcacttgccctgctatgctcggaccctttctgtacccttggcgcttacctgctggcagcctggccccaccggcatcactgggagtgggctgtgccaccatacaagccacatctgactggcggtatcaggctgtcgcagcgacgtggaagtggggtgaggaggtcacgtcccgtgcttcttgctggctgagggcaaatccctccccacgtgcgcctgttctctctccacctttccgccctaagcccccaggtgcccttactcactcatgttccttgagccaggtgtcttaggtctttgtgtggatgaggaggagcggaggtgtgaggtgtgctgggccttcagggcctgggaaggccatcccagactgagccccaccgccctttcccagctcagtccccaccgagctgacagcttggaaaggggcggttgggaagtgagtagcaccctctgataatgatactgatcaggccagcaggtttgtcaggggtgcacatcctgctcagcagagcatatgaagatcacagcttggtgaagctccactcgagagacctggagcgagactgctgtgcggtgggtgacaggtggaactccagccgggccggggctggtggagcccactgcgagcagtgccaggcacaagattctccccctctcatttcacagggacaaaaccaggctggggcccccaatttccttgccggttgaaccatagctggccaccagatccaccaagcctggggcttctcttgtcctttgaatggctgcttctcccaggtctgaacgaagacataggacaactctggt

SEQ ID NO: 3 - DNA, 35 bp, Drosophila melanogaster
tgaatgcggccgcatgggggctcagcagggcgaag

SEQ ID NO: 4 - DNA, 24 bp, Drosophila melanogaster
gactgctcgagagcaggctggttc

SEQ ID NO: 5 - DNA, 24 bp, Drosophila melanogaster
ctgctctcgagcagtcgggactcc

SEQ ID NO: 6 - DNA, 38 bp, Drosophila melanogaster
agtctagattacctgttaagcgcattggagatctgacg

We claim:

1. A method for treating a subject having aberrant and/or dysregulated expression of Dscam, the method comprising administering an effective amount of an Abl tyrosine kinase inhibitor to said subject.

2. The method of claim 1 further comprising testing the subject for aberrant and/or a dysregulated expression of Dscam.

3. The method of claim 1 further comprising inhibiting the activity and/or the expression of a tyrosine kinase in a pathway with Dscam.

4. The method of claim 1 wherein said subject has a neurodevelopmental disease selected from the group consisting of Down syndrome, epilepsy, bipolar disorder, and fragile X mental retardation.

5. The method of claim 1 wherein said Abl tyrosine kinase inhibitor is selected from the group consisting of imatinib, nilotinib, dasatinib, bosutinib, bafetinib, and ponatinib.

6. The method of claim 1 further comprising testing the subject for increased length of axons or axon terminals.

7. The method of claim 1 wherein the subject has Dscam overexpression before administering to the subject said effective amount of said Abl tyrosine kinase inhibitor.

8. The method of claim 1 further comprising detecting a lowered Abl tyrosine kinase activity after administering to the subject said effective amount of said Abl tyrosine kinase inhibitor.

9. The method of claim 1 wherein the inhibitor is an antibody against Abl tyrosine kinase.

10. The method of claim 1 wherein the subject has not been treated for a neurodegenerative disease.

* * * * *